United States Patent 7,745,391 (HUMAN THROMBOSPONDIN POLYPEPTIDE) - sequence listing, part 142

SEQ ID NO: 373923 - DNA, 6256 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagc

SEQ ID NO: 373924 - DNA, 5605 bp, Homo sapiens
actctaagatccctctctggtaaagctgatgggagaagttcgtccagtacatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373925 - DNA, 6879 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373926 - DNA, 6156 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccagcccccagagcagagcctgtgtaaacatgcccaggaggggaggaggggttgctacatatgagaaacagttaaaaataaatttaaaaagc

SEQ ID NO: 373927 - DNA, 6925 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373928 - DNA, 287 bp, Homo sapiens
ggagcaggaaaatccagtgcacatctctaatctcttcagcttaagtctgggcctgttcttgctgttggtgactctgggaagtttcagtgtgacccagcagcttcccacctggcctcaggacctgctcctagagggtgggggtcacattccagcactctggagtgattgggtttcttgtcaatttcccagatcctgtgtctccaggaagtccaggaagatcattactgggagcagctggaaccctctctgcgaatgatgggtaatgcagctccctgggatgcttgcca

SEQ ID NO: 373929 - DNA, 573 bp, Homo sapiens
  misc_feature (188)..(188): n is a, c, g, or t
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccctttcgcnagcactcagcagctatgacgctacggccgcccccctcccgatgtggagggtatgactccctcaaggtggacaacctgacctaacgcacctcgcccgacacgctgaggcgcgtcttcgagaagtacgggcagcgtcggcgacgtgtacatccacgcgggatcgctacaccaaggagtcccgcaggcttcgccttcgttcgctattcacgacaaagcgcgacgctgaggacgctatggatgccatggacaggggccgtgctggcacggacagcgagctggcgcggatgcacaatgacagcgcatacaggcgaccccacagagaatcaccaccaccagacagacggggaccgacaaccacgcaaagtacacgggagcaggaggcaacg

SEQ ID NO: 373930 - DNA, 7000 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaagaggaggactcccaggctcagagatgttaaggaacttccttgggggtcacaccagtgagtcagcagccccagccacgattcaagtccaggtcaacctgaccccaaagtctgtgttgagacattatgccacggtccctccagcactactctcattccaccaatgcttactgagcctgactccttgtaagtgaccaaggatacagcgatgagaaatgcacagcccggccctgcagaggctcagagtgcggcgaggacaagacgtgagaaccacggcgtgtgctgtgcctgagggagctgtggggacactgagaaggagcccctcacccagatgggggctgttcctattttattcctgcccacaagccaccaggtgacccctgaaaagctttgaggggaaaagaccct

SEQ ID NO: 373931 - DNA, 7145 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagagatgaagtttcgttatgttgcccaggctggtctctaactcctggcctcaagtgatcctgctgcctctgtctctgcctcccaaagtgctgggagccaccacgcctggcctcttgtccccattttacagtcaagagtaacttcatctgactaggggcattgttcaagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacact

SEQ ID NO: 373932 - DNA, 6230 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcgggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagccagggctgagcagtgggccatctgtcgctggaaaaatgtctcttccttcctaggcctacctctgttggtgcttttgtcttccaacctccctatgtagtaagaccagccaagcccacatgcccactgggagccctgaaaccagatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaagaaaagaaaagaaagaaaactcagctaggaattagaaacatcatttgtcctcttggcctgttcagctggtgactgtagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgctagaagagggataggggtggctggcatgatgggtgaggggaacatgagaatatgcagagccttgaaggaagagactgcagttcagccgcaagactcct

SEQ ID NO: 373933 - DNA, 2428 bp, Homo sapiens
ggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagggggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatgaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatatcctgtgtctccaggaagtccaggaagatcattactgggagcagctggaaccctctctgcgaatgatgggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtatctggacaggaagacttctcccatcagctttaccagaggaagctgcaggccccactgtggcccagctccctgggcatcactgattgctgtcagtatgtcacctcctgtcaccccaagagatcagagagacgcaagtatggccgagacttcctgctacgtttccgcttctgcagcatcgcttgtcagcgaccagtaggactggtccttatggaaggagtgacagatactaagccagagcgacctgcgggttgggctgagtctgtccttgaggaagatgcatcggagcttgagcctgccttctccaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactgatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagc

SEQ ID NO: 373934 - DNA, 678 bp, Homo sapiens
  misc_feature (570)..(572): n is a, c, g, or t
  misc_feature (577)..(577): n is a, c, g, or t
  misc_feature (603)..(603): n is a, c, g, or t
ggaaattaattctgtccaagccagcatggtggcttcatattaagtagtaacagaagtctgaacaatggagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaaaaaaaaaaaaaaaaaaaaaaaaaaaaaaaannntttangggggggggggggggaaaaaaaaaanttttggggggggggggggggcccccgccccccctagggggggttattttttgggggggggggggggccccctttt

SEQ ID NO: 373935 - DNA, 1824 bp, Homo sapiens
  misc_feature (1320)..(1320): n is a, c, g, or t
  misc_feature (1444)..(1444): n is a, c, g, or t
attgactaaacctaactagaagccagaggccaaaggaatctgtcgatatacaagctagcttcccagtggatggagcaggatggagaagaggaagaacgggcctggagggacaaacaaagggttaaaagaaaaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtatcttgtcaagtggttctggttacttacaatctcataagctttggaaatgaaatgtgcctgtgacactcaagggtactggttagttttacagtggtctttacctaccatctgagattaagattatacatgaaatattanttgctttatatataagaattggtccaagctttctgttttccttacaaatgtacttgcctcatcttttccctatcaatttcattttattgtggtaaaatacatagaacataaattttaccatctnaaccatttttaagaacacagttcagtggaattaaacacattcataatgttgtgtaactatcaccaccatccgtgtccataattctttgcatcttataaaactgaaactctatacccattaaacgatgattccccattccgacctctttccagcccctgacagccaccattctactttctgtctctgtgattttaactctcctaagtgcctcatgtaagtggaatcatacagtatttgtcattttgtgattgatgtattttacttagcataatgtcttaaaggttcatccaagttgtggcatgtatcaggattttcttccttttaaggttgataatattctgtagtacatatagaccacattttgtttacccattcattca

SEQ ID NO: 373936 - DNA, 473 bp, Homo sapiens
tcagtcaaaagcctgaatttcaggatctttcagatcacacggaattactcagcaaggagcagggcagaaaacaggaggttactggcatattccaggccatgtgtctcctgatctgtgccgagatgtaccaagtgtccagactgcagcacatctgtgagctgttcatcattacccagttggcagccagaaccctgaggatgaggcccaacccccagctgtgaagctggagagactgaatggctcaaaagaaaaggtgtccaggaaccaataattgggggatctcccagtgaggcaaccagatctgtacctgttcatttattctttaatttgttcactcaagaaagagcctactatctgccaagcagtcttgatgctgcagatacagcggtaaatagacaccaatccctgacctcaaggcacttatattctaatagtgaagagacagtaaactaaataaatcataccatatatta

SEQ ID NO: 373937 - DNA, 5876 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373938 - DNA, 5813 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcagttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373939 - DNA, 5755 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtattacccggttgtacaaatacctttacacatcggcgtgtggtggcgtggggggtggggggggcgcggtgtgggcgggcggggggtgggggtggagttggcggtggggtgttgtt

SEQ ID NO: 373940 - DNA, 5822 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaagcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373941 - DNA, 5822 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373942 - DNA, 4482 bp, Homo sapiens
aaacttactagaaacatgcgtagggccccgcggatccaagctactggtaactgaaccatggtgcttagcatgtctgcctagcaaatggcctggtacatgcactatgtgctttgcgaatgatttcacacgaaataatacccagagacctggcccaggatcgagcggttattgaaaaagaatcatgcatggatttcctggagggtctatgtcactggaatctttcaagaggacctcccatcgagactctcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373943 - DNA, 5767 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373944 - DNA, 3735 bp, Homo sapiens
aatactactcgaagtagtggacaagatatatataattgtaagtcacataataacttaaatcctgatactaatttaaccaaaatggtagtaaattatttgggaaaacttgtgggaatggtaggagatgtatcacagagctggatctcatctattaaagaggaaatcaatagctgatatcttaattgatccataataaaacatattcggttaacagtctttttcttaaaacttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373945 - DNA, 1510 bp, Homo sapiens
tatcttacccttctccacttcagagtccacccaaccttttggaactacctaatagtctagttcaacattagatagtataaacacacgaacatacctttttttgcttagcaacgaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373946 - DNA, 2447 bp, Homo sapiens
  misc_feature (2428)..(2428): n is a, c, g, or t
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtgggaggaacggcagtttttgttggaaaagcacaggtggggcccttcgaatanggttactttgaagggcagg

SEQ ID NO: 373947 - DNA, 2348 bp, Homo sapiens
  misc_feature (1844)..(1844): n is a, c, g, or t
  misc_feature (1968)..(1968): n is a, c, g, or t
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtatcttgtcaagtggttctggttacttacaatctcataagctttggaaatgaaatgtgcctgtgacactcaagggtactggttagttttacagtggtctttacctaccatctgagattaagattatacatgaaatattanttgctttatatataagaattggtccaagctttctgttttccttacaaatgtacttgcctcatcttttccctatcaatttcattttattgtggtaaaatacatagaacataaattttaccatctnaaccatttttaagaacacagttcagtggaattaaacacattcataatgttgtgtaactatcaccaccatccgtgtccataattctttgcatcttataaaactgaaactctatacccattaaacgatgattccccattccgacctctttccagcccctgacagccaccattctactttctgtctctgtgattttaactctcctaagtgcctcatgtaagtggaatcatacagtatttgtcattttgtgattgatgtattttacttagcataatgtcttaaaggttcatccaagttgtggcatgtatcaggattttcttccttttaaggttgataatattctgtagtacatatagaccacattttgtttacccattcattca

SEQ ID NO: 373948 - DNA, 320 bp, Homo sapiens
atgacaagttttcattccatgaagtaaaggataattatattccagtgataaaaagagcattaaattcagttccagtaattattgctgctgttggtaccagacaaaatggtaagtatttaatattcttttttgtagtgagcatgcaaatattatatatactttaaatagtgctaagtttattaatggataatagggtttgtttttgaaaaccaaaatgactttggttcaatgccagctgctatcgcttcatcatttgatacgataaaaaaacaacaaaggagaggatcatgaacttctgctgtgattccactgggtgcaaa

SEQ ID NO: 373949 - DNA, 694 bp, Homo sapiens
ggtggggggtgtttagatcattaaagaaatggtttcatcatccactttctctcatgtcccttttctcatcagctgctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcgtaattgactctgtgtatctgatagcctagttttttataaaatatttttcaaattatactattttaaaatttatcattttttaacatacgttaatactagtcttagtttggaagtttggctaatgaggctaaagtgccttcacaacagtttatctggctagataattttgaagcgttagggtttgtgtgcagtcccttttataaggaggcaaaatgtccagatacggaatttttttaactaaatagtggcccttagtagagtcatttgaatgtggtgctatactatgtcacataggcattgtaggaaatagaatttatgttgaatttccccaaacaatcacatcttcaggttcctaaaagggaaatgacagaattggtccatatatactgatagcgatggttaagctaaactaatttacttcttcattttttcatccatataatgaac

SEQ ID NO: 373950 - DNA, 6055 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaacacacacaccccccccacccacacaccaccacaccccacccacaccaatccacacccccaccacacaacacaccagcacccccccagcccccgcagctcggcggcaagcatacggagcggggggagtggtgccgcccaatgccaagtggcgtcttttgctcaccacaggcggtccgctgagtcgtcgagcgcccgaacacggatcgcgaacgccagcgaacactcagtgcgcgttccatccacatgggaagcacgagcggccaccgcatagccggcttgctctcgtatgcgctccctcaatcaacagctagcacagcgcacgtgatgcggcacgctctgccggtcgcacacgcacaacacggggatgc

SEQ ID NO: 373951 - DNA, 5757 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaaaaccacacaaataccaccccacaaccacccaacacacacacacctctgcggcgcgcccccaaactctc

SEQ ID NO: 373952 - DNA, 5828 bp, Homo sapiens
  misc_feature (5720)..(5722): n is a, c, g, or t
  misc_feature (5727)..(5727): n is a, c, g, or t
  misc_feature (5753)..(5753): n is a, c, g, or t
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaaaaaaaaaaaaaaaaaaaaaaaaaaaaaaaannntttangggggggggggggggaaaaaaaaaanttttggggggggggggggggcccccgccccccctagggggggttattttttgggggggggggggggccccctttt

SEQ ID NO: 373953 - DNA, 5677 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattaagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373954 - DNA, 5847 bp, Homo sapiens
  misc_feature (97)..(97): n is a, c, g, or t
agaggctgtcctagaccgatcgcgctacctggagcctccgcggcggcacctcacgtgaaggtaagcgctgtgctccactgagattgctgtctccgtnagcgcaccagtgcgcgtcgtgtgccaatcggatcgtcatggtcggctctcgggattctcgtctagacgaggtgagacagagaagcgcccccggacgcgtcacaccggaagccgtccttgatactgaattcaaagagtagggaagtgacgtcgaagcgtcatgagcggagatcgatcgcgacgagatgccaagcgagcgaggatgctgagatgacggcgcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373955 - DNA, 5352 bp, Homo sapiens
attgactaaacctaactagaagccagaggccaaaggaatctgtcgatatacaagctagcttcccagtggatggagcaggatggagaagaggaagaacgggcctggagggacaaacaaagggttaaaagaaaaggtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373956 - DNA, 5689 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctggaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373957 - DNA, 4729 bp, Homo sapiens
actcacggccctatccagcgctgcctttgtgtggtgcagcagtagctagagagcctagcaagcttttcctagagagttaattcagttcggtgagttcagtgagcagtatgggctgagagagccctcaaaattcaacgtagcactggctctcccagcagcaggcattgttcaggtgagacagaatggttgcctgaggaagtagtgtgctggggagactgcagggattaaggtcatcctcttccagattttcattaagtctgaaatgctctccttggctccacaagagatcctcttgctattcctactgtggtgtacggacagcttatggtttacttcttacagtttcctgtttcagataaggggaagcatggccaagatggttctgtgagtcaggcccagaagggtaatggggttgttttcttgggaggcacatgggcacgggtagtattattaatatttcaagccaattggaaaggattgatgtttcattataaaaatatgaagcaaaatacttcatttcagtgtttctatttctggaaatacaaactaagtaacaaattgttgtcttgacttgcaaattgttggtttcaaggtcaacatctgaactttctttattgctccctttaaaattaagaagtttctggattaatggtagttatcactcccaaattcagattctgcatatcagcctagctgtccctaatgtggtagtctaattagaaggaaaattgctggaataaccctgcaggtttatctcacttgtttcttgtttcccttttgaacctttcaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaaaaacaacaaaaaaagggggggggctaaaggatcctgagggcaggttacggtccagttttgcaaggtgccaaggggcgttaaagaggggcgggttaaactggggggaagctctgggttggagactcttgggggatatggacactcgagttagccgataaatctttgggacgattggggatgtgtaaacagg

SEQ ID NO: 373958 - DNA, 4320 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaaccctggagcttttatacactacatttcttttttattattatgaagaatgggatacctcccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctacacttatatatagaaatttatctgctttatattttcaggtcccctaggtacttgttcggttca

SEQ ID NO: 373959 - DNA, 1688 bp, Homo sapiens
ccctttcctggctctggttacggccttgcgagttgaacaaacttgctgcaggcggattggcggctgggagctctcgggctggggcgttgtatttattaatttatattccgcggcgccccgcgcgggcggctcctttgtgtccagccgccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatcttgtgggcctctacaactttctttaaattagggttgtaaaataccacgtccacacactggcagcagaacagcaagttatttaagtcacagtatcacatatccggggagtcctctagagct

SEQ ID NO: 373960 - DNA, 572 bp, Homo sapiens
acccacccacaccccttcaatctttttcatcacacttgcaaaccagtagaaagatgaaaggcctgtgacgatccaagacacttggaggttgatccacagaggactgggacacaccacgagaatctcccagagtgtcattacagtggaagacttcgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgt

SEQ ID NO: 373961 - DNA, 1654 bp, Homo sapiens
cccgtcctcccacccccaccagcagttacagggctgggtgcggagaccaactctggccagacacagaggagcagcaagaacccggggcaacggtcctaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaagcagaaattgttacagccagccaaaatttatttgtcaaacatagatagctttgaatttagagaagaagagcttacctctcactctagctctgtgagcccatgaccaactctgctgttgcagtggaaattcctgggaaatataaactaagaggagatacgacctttactgtgctgtcacagggctgtaaaaatgaagaatttgaagaatgaagtaggtcagaggatgcaattcttgagtattccagcattatttatttgatcagagtaaaatacacttcccatcactacaaactgagcacaactacagttgtctacacattcatatttttgacgtgccaacattttgcattctacatgaaacatttggtttaaacaaaatcttaagaattctctattttgtttcccatcttccctcctgttctctcccatcctccaaagatgttttatattaactgctatgagatttatttgccggtcacgtaatacggaggacagcagggaa

SEQ ID NO: 373962 - DNA, 658 bp, Homo sapiens
gcctgtctgtccgggttcaagtagacaacatcgaagtagctgggagaaggtacaaagagttctcctttctctgtaaaaaagatgtaggtggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagacttcgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgt

SEQ ID NO: 373963 - DNA, 1673 bp, Homo sapiens
cccgtcctcccacccccaccagcagttacagggctgggtgcggagaccaactctggccagacacagaggagcagcaagaacccggggcaacggtcctaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctacgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagacttcgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgt

SEQ ID NO: 373964 - DNA, 768 bp, Homo sapiens
taccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggg

SEQ ID NO: 373965 - DNA, 5665 bp, Homo sapiens
agtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373966 - DNA, 660 bp, Homo sapiens
cgccacgcagttttatccggtaaagcgaatgattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactca

SEQ ID NO: 373967 - DNA, 5959 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373968 - DNA, 5722 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373969 - DNA, 5776 bp, Homo sapiens
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaaggattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373970 - DNA, 5822 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttt

SEQ ID NO: 373971 - DNA, 3086 bp, Homo sapiens
ggctaggtacgaggcgggtgttgaatcggccgaggatccgtcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373972 - DNA, 2901 bp, Homo sapiens
aaaaaaaaacccccttgcgggtgggccggaattttttttaaaaaaacaacaattggccccttaaacctttaagcctttaaaggggtgtgttttttttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373973 - DNA, 3606 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactca

SEQ ID NO: 373974 - DNA, 1303 bp, Homo sapiens
cgaagaggggccggggcgccgaagccctccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373975 - DNA, 1066 bp, Homo sapiens
tgttatttcatgacgggacgggatttgattgatgtttattgcacttggcctgacaatcacacaactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373976 - DNA, 2166 bp, Homo sapiens
gcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaa

SEQ ID NO: 373977 - DNA, 467 bp, Homo sapiens
cgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcgaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcag

SEQ ID NO: 373978 - DNA, 5595 bp, Homo sapiens
gcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373979 - DNA, 5537 bp, Homo sapiens
gaggagagcgagctgagggagaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373980 - DNA, 817 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggg

SEQ ID NO: 373981 - DNA, 773 bp, Homo sapiens
gcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgttcctttcagaaccaaaatgagatatagtagcgggggaaagaaagcttgtgagggcttggttaaggatctggtatggaagggtgggaacttttaggtccgcattttgg

SEQ ID NO: 373982 - DNA, 5783 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373983 - DNA, 5668 bp, Homo sapiens
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgattcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatacta

SEQ ID NO: 373984 - DNA, 2748 bp, Homo sapiens
  misc_feature (2694)..(2694): n is a, c, g, or t
gctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctaaggttagttgtggcaatnaaaatgattaaggatactaatataagagatcaggttcgtcctcatgtcatacct

SEQ ID NO: 373985 - DNA, 324 bp, Homo sapiens
acattttctgtggctattattcagcctctttttttcagcaagccctactcctgtttcattggctcataaacaaagtggctaaggtggtagggatgaaagttatccatcgattcagcaaaagggtcttccattcaccaaaaccgatcaggttacaaccgctgctgagtgccctatctcccaacggcagaggccaacactgaaccctgaatacggttcaattccctggggaaatcagcccaccatctggtggcatgttgattacatgagaccacttctatcatgaaaggggcaatgatttgttgtcactgaagtagacatttactc

SEQ ID NO: 373986 - DNA, 482 bp, Homo sapiens
aggcctagcccagcatcacaggccaatgaagaaatatatccagcctgagcagctccaccaggagttgttcctgatgggacttcacctgctgagctcacagctgcgctcagggcagcctgtgcaccgtctcctggtctcagcagcccctccctgccccctgctcccaggtcagggctcagacaccacagggcagaggtactggcacctattcatgccttcctcagtgagggcctattctgggacgaacatcgggccccgactctggggctgggagatgggattttcccatgtgccagggaggaaatcaagggagtgtgatgaggtcaggctcagaggctcactcctgtggtcccagcactttgggaggccaaagcaggaggatcgctccagcccaggaggtcaaggctgtagtgagccatggtcaggcagttgcactccagcttgagtgactgagcaagaccccatctttaaaaataaaaaaa

SEQ ID NO: 373987 - DNA, 1353 bp, Homo sapiens
aatgaactttgggggacacattcaaaccacagcaccttccacaaaataaaagtaagtattgccacaactctttatttttaaccaaatctctgtaatgtcactctattcatagattaagatttgtacctccaagtccagtttgctcagattgggcagatgtcattaattagtcattaatcatctagaataatacatcttgtccacccaagatttcacatggtttttaatttgtaaacagtaaaatgtaacatgaagaagactattttaagtgctataataaaattaggttttgctaataggacaatgtgtttctcctcttaggtaacattttcacattaacagaggtcttctgggagacagtacctttactccaaaatttctggaaactatgttccacagaacactagtacttaatcctacttgaaggaaatgattttgtgaaacatgtatgagagctctgtgtactatatttcttgggggaaaaagtcacattatgtgcctatcaatatgaaagaaaatggagttttattttatttaactcagtgtaattcagacttcaccatagaactcccattcccaatacctattgcagatgtgattctactttggcagatgctgcgataaccaaaaggacttcgaagatgaaaatgtcagcattatggcagatgtatgattactggtatggtgaggaaagcaactcccatcatgctttgtaaccagctgcttgctttttttgaatgatacttttcaatagaatagaaagcccactagtcctatcttttatatatacattatatgtatttaaactttcttattgatcaatatttaggtgataagcattttctcactgtgaaaaataccttattgaataggtctgtgtttattactgtacataagcaagagtttctctaaggtatttatcaaaagtaggattgctcagtcatagttaatatttactttcaacctcactagatactgtcatagaagtagagagcatcagtatgctcccagtgcacaatcccttcaaccagtgaaatatgttttccttatttccttatatccttacttctggtatgcatagtaatattttcctggttaatagtgaattgggcatattttcacatctgaatattggctaaacgctgtaacttgccaatttatgtctttgcctgtgttcctttaaaaaagcttttaaaatataagaattataagattcttaaaaaataaaattctagatagtagtcctttgttataaatggacttaccttctcccatattgtatttatgttgatattgtcatatgaatacgttaaatgtggatacaatcatagctttcattattacctaataatc

SEQ ID NO: 373988 - DNA, 1706 bp, Homo sapiens
tggatcgtgttgcgttcggcttcgtactgtggctggtgctgttcgcgtggtgctcgtggtccgcttgcagcgcggtcgctgcactgttgctcttccccttcggtcgctgtggttgcgcgtgcgtcgtgcggttctgtgcggtcgtcttgtgtggttgtgcggttgtttgacttctctgcgcccggcgaattagataaagcggcgggagatttttgcgcggcgatagcgcgggtgccctgtgtctgggtgtttgtctcgggggtattgttctgggtgtgtgtccctttgtgcccccccggtgggggttctttcctaggtgtcgtcggtgggtggttctcgctctgcgtgtgtgtttgtggcgcgctgttttggtttttggctctcttattggcccctttttcatagaatgtgggtgtgcgctttgtgtgtccccctgggtggttttttgtgcgcccccccctctgtgttgttgtgtgttttgtgtttgtttgtggttgtttgggtgtgttgttgtttttttttttttttttttttttttgttttgttctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagatttttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttc

SEQ ID NO: 373989 - DNA, 1901 bp, Homo sapiens
ccctggaccacttcttcccccctaccccccgccacgcgaggcgtgcggcgcacgcaagatgccgtgatttcctcaggatcaagggattgaagaatgtcccggattccactggggaaggtcctcctgaggaatgtcatccggcacacagatgctcacaataaggtgggagattcaggaggaatcagatatgtggaaaataagagaactggaaaaacagatggaagatgcttaccgggggaccaaaaggaaaatgctacccagcagttcaagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacagatggggtcacagtggttataaagagttataccctgaagaatttgaaacagacagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagttctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagatttttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtttaggttttccctgaaactaagttgaattatttccaaaatgaaacaggcttc

SEQ ID NO: 373990 - DNA, 1298 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 373991 - DNA, 673 bp, Homo sapiens
  misc_feature (15)..(15): n is a, c, g, or t
  misc_feature (77)..(77): n is a, c, g, or t
ctcatgtcctgtccnatggcagacccagtcaatgaaagtgcgagcagagagtaataccttggtagaaatgaaactgncggacccacctcaatcagagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 373992 - DNA, 1311 bp, Homo sapiens
cacacttggtaactaatgaatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttctgaatcttcctctatttatattttaaataaagaaatacaatataaatgtaaaccaggatatgcaacagcagatggaaattcttcaggatcaattacatgtttgcaaaatggatggtcagcacaaccaatttgcattaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccacctagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttat

SEQ ID NO: 373993 - DNA, 583 bp, Homo sapiens
ttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttat

SEQ ID NO: 373994 - DNA, 725 bp, Homo sapiens
caggattcggcacgaggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttctgaatcttcctctatttatattttaaataaagaaatacaatataaatgtaaaccaggatatgcaacagcagatggaaattcttcaggatcaattacatgtttgcaaaatggatggtcagcacaaccaatttgcattactgcttgtattgcattccgtgctcacgctcagaaaaagttgtacatgtcgggggagaaatgagtgcttaattctgaatttctgctagcgtcaggagaatcagaccttaataatttgtatcaatgatgctactgaggatatccaatcaa

SEQ ID NO: 373995 - DNA, 785 bp, Homo sapiens
  misc_feature (544)..(544): n is a, c, g, or t
  misc_feature (551)..(552): n is a, c, g, or t
  misc_feature (638)..(638): n is a, c, g, or t
ttgaaatgctaacgtcagtatgtagcacaagttaataactattaactatttggattattttataattttattttatcctaaactactcattaggatgcattttatttgctcatgaaagagaaaattatgattgttaattgtttttttctgctttcagatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattgnaaagatnnaagaaaaactcgaggaggggaccggtacccaattcgcactatagagagtcggattacaattcacatggcgtggatatacaaacgtntagactgtgaccctggggttacccaacattaattgccttgcagtacattcgcctttcgccagatggtgtaataacgaataggcccggaccgaacggattttcaacagtgagcaagctgaatgtgcaatggcatttgtgcgtttttgt

SEQ ID NO: 373996 - DNA, 311 bp, Homo sapiens
gcacgagcgctctctctctctctctctctctctctctctctctctctctctctctctctctctctctctctctctctctctctctctctctggactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaa

SEQ ID NO: 373997 - DNA, 1295 bp, Homo sapiens
aagcagtggtatcaacgagagtggccattacggctggggaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 373998 - DNA, 1652 bp, Homo sapiens
tttgtaaccagaaaatattcaaaatgatattaataaacaaaaaacaaaactacatatccaacatctttactgcaccagaaaaaaaaataggacagagtttctggcagagacacctatggcagtcaatgagaatagagaaaataagtaaattgagagctaagaacaaccctatcacttttctactgtatactatgtagatcaggaagatttgctactcttacactctgtcttcattcttaaattgttgtgtgtgggttttattcttgaagacaatgcaggagagttcatatttcatatcactccaaaatataaattttatattcattaacaattacctcctcaaatagtcatgtactcctagttagtgatgcttttcattcctaatttgtacactggaaagcatttaagctaaaggcatttaagctaaatgaaagaaaaacactataagtgagatgattaaaatataatctagtgatttatttatgtaacttattatgtaattcttcagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 373999 - DNA, 1314 bp, Homo sapiens
aagcagtggtatcaacgagagtggccattacggctggggaatgaaagcagattcaaagcaacaccaccaccactgaagtatttttagttatataagattggaactaccaagcatgtggctcctggtcagtgtaattctaatctcacggatatcctctgttgggggagaagttttatgttattttcccagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374000 - DNA, 1221 bp, Homo sapiens
aagcagtggtatcaacgagagtggccattacggctggggaatgaaagcagattcaaagcaacaccaccaccactgaagtatttttagttatataagattggaactaccaagcatgtggctcctggtcagtgtaattctaatctcacggatatcctctgttgggggagaaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374001 - DNA, 1136 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374002 - DNA, 1225 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcatgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374003 - DNA, 1330 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaactgttgtgtccagttcataaaatgtttgtggc

SEQ ID NO: 374004 - DNA, 1248 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaataggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374005 - DNA, 989 bp, Homo sapiens
  misc_feature (873)..(873): n is a, c, g, or t
  misc_feature (892)..(892): n is a, c, g, or t
  misc_feature (971)..(971): n is a, c, g, or t
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattcccgttgtcagtatatgctccagcttcatcagttgagtaccaatgccagaacttgtatcaacttgagggtaacaagcgaataacatgtagaaatggacaatggtcagaaccaccaaaatgcttacggtggcagcaacagaacttattnggacagtgatcactgattnggtgaacgggattcgcttcatacgtctaccattggacacatgtggatggaactgagttcactgtcggatgacatctaantgccactatagactgttt

SEQ ID NO: 374006 - DNA, 988 bp, Homo sapiens
taagtattttattcaagtattttttattagaattaaataaaataataaatagacacctacatatgtatatgtacacatatgtgtgtacatatatgtacatatatatgtagtcctcctatgagtgtgaattatcttgagacttaaaaagaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccacctagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaa

SEQ ID NO: 374007 - DNA, 694 bp, Homo sapiens
atgaatgaaagatttcaaaccccaaacagtgcaactgaaacttttgtattagcatactactgagaatatctaacatgttgttactaatcaatgtcattctgaccttgtgggtttcctgtgctaatggacaaggtaagttaaaagagatctaaacactcagcttccctcttaaatgtaacttcatgtaatatctagctttgtatgtctataattattttatgaatcaaagaggatttattcactatgctagtagaagtgacatattttgtgagagtataacagaaattaattttataaaaaattatctcattttaacttaaagaaaaaatgaataatgttttatttgttttctaagttctacagtgtaaaaggcatttaatattgattatggagatatgtgaatatactcatgaaactttaagtaggaaacatgtcattagacagattctaagcttaaaatgttcagaattttcctatacgtaatacaaggggaacattgggagtgactgatgttttcataatcttacatatggtgatttttatagatttatatatcaaaaaatcaaataatacattttaaattatgcagtttcttatatttctattatagcttaagaaagctgctaaaactaattaacattaatatcaacttactacgtcaacaaaattagcaacatacatatataatgaaaaa

SEQ ID NO: 374008 - DNA, 561 bp, Homo sapiens
atttcatctcttacaactcaatctgcctttacataaaagcaatcttatcatgtacagactagttagggagctgcatgagagtatcagcaaaatatgttagttgccaataaaaactttgttgtcttccctttctttgtatttcaaaattatcagctgcttgtattgcattccgtgctcacgctcagaaaaagttgtacatgtcgggggagaaatgagtgcttaattctgaatttctgctagcgtcaggagaatcagaccttaataatttgtatcaatgatgctactgaggatatccaatcaaaaaattatctctaccctattgtttactacagagaaaacaagtaaaggaaaagggtaagtgggtgggctgaatgtttacaaacctcatacttgccaatggattctttacatgtaaagttctctgaacgtgctcgacctttacttagtatgataaagagaatgcataatgaacaaaggaaatctttcagtggcaaaagttgattttttttctttcctctttatatattcacaaagagttttaaagataaattgctgaatgta

SEQ ID NO: 374009 - DNA, 805 bp, Homo sapiens
  misc_feature (711)..(711): n is a, c, g, or t
  misc_feature (725)..(725): n is a, c, g, or t
  misc_feature (743)..(743): n is a, c, g, or t
  misc_feature (785)..(785): n is a, c, g, or t
cacacttggtaactaatgaatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttctgaatcttcctctatttatattttaaataaagaaatacaatataaatgtaaaccaggatatgcaacagcagatggaaattcttcaggatcaattacatgtttgcaaaatggatggtcagcacaaccaatttgcattaatactgttngatgattcgtgtangctagaagtgacatgcgngagaatgatcgtatctattctgtacgtagaatcgactatatngatatgagtctgggatcatc

SEQ ID NO: 374010 - DNA, 832 bp, Homo sapiens
gccaagcgtggactgactctcttaactaccaccgctacacgaacatgctcaaaatcagatatagaaattgaaaatggattcatttctgaatcttcctctatttatattttaaataaagaaatacaatataaatgtaaaccaggatatgcaacagcagatggaaattcttcaggatcaattacatgtttgcaaaatggatggtcagcacaaccaatttgcattaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccacctagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttat

SEQ ID NO: 374011 - DNA, 1238 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374012 - DNA, 1103 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaaggactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374013 - DNA, 1095 bp, Homo sapiens
cacacttggtaactaatgaatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcaacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374014 - DNA, 1243 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374015 - DNA, 1820 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaaaaaaaaaaaaaaaaaaaaaaaaaaaaaaaaaaaaaaaaaaaaaaaaaaaaaaaaaaaaaaaaaaaaaaaaaaaaaacaccttgtcgcccgcctggcccaagctaattttagattcgggcaggtttatccttgcggccaaatttcgggctaattggcccatttccccttatggggggccgttttacaattaatgggccggcgtttaacaaggcggggccgggaaaacccctggggtaccccaacttaatcccttggaagaaaatccccttttggccagttggggaaatagcaaaaggccccgccccgatggcctttccaaaaagtgtgccaccctgaaggcgaaagggaaattgaaagcgttaatatttttgtaaaatccgggaaaattttggtaaaccgccaaatttttaaaccaaagggccgaaatcggagaaaccttttaaaaaaaaatagcccccgattgggtgggggttctccatttggaccagacccccttttaaaagggggccccacgcaaaaggg

SEQ ID NO: 374016 - DNA, 1218 bp, Homo sapiens
  misc_feature (1169)..(1170): n is a, c, g, or t
  misc_feature (1178)..(1178): n is a, c, g, or t
  misc_feature (1188)..(1188): n is a, c, g, or t
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatctnngggcatgnggtgcctcancgaacgaagtatatgtgacagtaggaaata

SEQ ID NO: 374017 - DNA, 1263 bp, Homo sapiens
ccagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttactataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttatgtattgttttactcctttttattcatacgtaaaattttggattaatttgtgaaaatgtaattataagctgagaccggtggctctcttcttaaaagcaccatattaaatcctggaaaactaa

SEQ ID NO: 374018 - DNA, 12588 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaaggg

SEQ ID NO: 374019 - DNA, 12675 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaaggg

SEQ ID NO: 374020 - DNA, 16017 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374021 - DNA, 15963 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374022 - DNA, 7941 bp, Homo sapiens
acggaatatgaggaggcggtcctgcttttatttcagtgcggggcgggggttcgttgacagtacatgggcgtgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374023 - DNA, 6397 bp, Homo sapiens
  misc_feature (40)..(40): n is a, c, g, or t
caactctggcgcgagctgctaactcagggcgagctgctanctcagggcgagctgctaactcaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374024 - DNA, 16144 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcagtgagaagtatatgtgggaggggagaggaatggggggtggggcagggttggtgatgagttctccatgtcccctgtgtttttctgcttctaatacaaagatttgtaatttgtttttgctttttggtagagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374025 - DNA, 9027 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggtgagggtgcgcctcagtttgttaattacctcttccctgccagtgacttcacactttaaataaatactcctcccaaatgatttcaaatgacagcacagtgaaactatttttaggggggaaaaaaagtctctgtctcaagcactcaggaaccttactttgtgttttcaggagatactggattcccttgcggagctttactccctgttacaagaggaagatatgtgggctggtctgtggcagaagcggtgcaagtactcggagacagcgactgcgattgcttacgagcagcacgggttctttgagcaggtaaacctcagaccactgacggtcttgggtgtgtaatgagaggtcatttataacggttctttaataaaatgtcctcaagtcggagttcacgttctctttttttgagatggagtcttgctctgtcgcccagcctggagtgcagtggcacaatctcggctcactgcaacctccacctcccaggttcaagcgattctcctgcctcagcctcccaagtagctgggattacggggccacacaatccaggtatctgggatttacgtggggtttgccggtggcgtgtgttcgt

SEQ ID NO: 374026 - DNA, 4131 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatgtccccctaagaagcacctgctccaacacaccaacacacatagaagtccggtaccg

SEQ ID NO: 374027 - DNA, 253 bp, Homo sapiens
caatggacaggaatgctgaaggccacgggcagtcagtttccttaggacacagcacagttagaacctaaggctagtaagttgtggcttttacatgtgaacccttcgcttcactgcctagccttgccaacatagttagactatagtagggtctgtagtgacgttgacctctgtcacttgcaaaattaatcgacctgtttataatttctggttttcttgatcaggaaatgaagatttgctcagcaattataaacct

SEQ ID NO: 374028 - DNA, 494 bp, Homo sapiens
cgtccatgattgcggtcgcccggtgcttcgcccagccaaactttaaggtgggtctccacgtcgtcctatcacaggcgcaggctagagccactcagatgcccgcgcgtcacggccttgcaggagctgctgatgtgcctcacgggctctgcgctctccacagtggccagcacccctgtgtgttatgtcctttgctgtgagggcaagggatggttttctctttggttcactcttgtctgtagtgcttggaacgggcctgcctgacactcggcagatgccggaaggtgtcaagtgaacaaataaacagattgggcctcagtcgcagcatggctgcctttgtcatctaggtccgcgctgcccaacactgaggccttctggctgctgctccaagtggaggaaggggtttgtcccccagcggcttccccagcccgtcctgagggcacacagcctggcctggtgctgaaactcgactggcccttggtggccctgagcggccg

SEQ ID NO: 374029 - DNA, 385 bp, Homo sapiens
agggccccagcatcactgtggagttttccgactgcaaagcttctctccagctccccatggagaaggtaagctctgtgacaatgtcgtttcgttttaagccttgtgaagatactatgtttcagtctatgtgaaatgttaattagacctgtgtcttaggcaatctctgagtagaaccagttgtatcaggtgatcggcctggttggcacaggggctttcctaatgccaggagaccagtggaggggtgtcacctgagaacttggtactctggagcagccccctctcctggtgaccaagaggagatgccagcccatcccgccgtgaactccttccattctgatgcctggcaggcttactgagaacctgagttgagtccatgcctgtctgt

SEQ ID NO: 374030 - DNA, 374 bp, Homo sapiens
gaccagaccactttgatgaaaaagtaccttcagtttgtggcagctctcacagatgtgaatacacgtgagttgatcctttttatcattaagaaatgcataaataaggccggatgcggtggctcacgtctgtaatcccagcactttgggaggccgaggcgggtggatcacctgatgtcaggagtttgggactagcctggccaacatggtgaaaccacgtctctactaaaatacaaaaattagccaggtgtggtggctcacgcctgtagtcccagctacttgggaggctgaggcaggaggatcgcttgaacccaggaggcagaggttgcagtgagctgagatcgcaccactgcactccagcctgggtgacagagcga

SEQ ID NO: 374031 - DNA, 395 bp, Homo sapiens
caacatgacattcttaaaagagtatatggaggaagagattcccaaaaattacagcatcgctcagaaacgtgccctgttctttcgctttgtagacttcaacgaccccaacttcggagatgaattaaaagctaaagtgagtcccactcttatgctgtagaagggtatgggtatttggtctggttttctagggaactttgggcccttttctttttttgctgtgtcactcttgaataaatagtagagtgagccaggtgctgtggcatgtgcctgtaatcccaggtactcaggaggccacagcgggaggattgcttgagctcaggagttggaggctgcaccgagctataatcacaccactgcatcccagcatgggtgacacaatgagactctgtctcaag

SEQ ID NO: 374032 - DNA, 231 bp, Homo sapiens
ggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtgatgtgctggccaccgggggcctttcctcagactctgttgaacagagaacagactctgttgtgcaggctggggctgaactct

SEQ ID NO: 374033 - DNA, 533 bp, Homo sapiens
ttcggtgtggttggtggctaaacgggttcatgtgcagctccaagctttggagccactgagactgggggcggttcccccatagctccctccccgggatcttggctaagctggcctcacagacactctgaaggcccctgctgtccagaccctcttggctttttggaagcagtgaggagggggaatccaggtgccctggagtggctccacagtctttgctcagcggggccccacacctgctcacacacggcccctgccaggtaaccacctctgtagggcagagcattagctactggagaacattccttatgccattttctagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacg

SEQ ID NO: 374034 - DNA, 7403 bp, Homo sapiens
gttctttgagcaggcacaagaatcctatgaaaaggcaatggataaagccaactgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374035 - DNA, 5638 bp, Homo sapiens
tgcaaggttgtcgactggtgctgtcgtagacaacgttcgggacttggtgaaaacgcgtgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttgaaaagttcaacccctgctgggtgcagtggctcacgcctgtagtcccggcactttgtgggggccgaagttgggcggatcacttgagcccaggagttcaaggccagcctgggcaacatggcaaaaccccgtctctacaacagatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 374036 - DNA, 15297 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtttattgtcccttgtttatgttaaaatgcttgtttccatgaggggtttcttccctctcaatgcccctagccccttgggaaccagaggccccagagacagtgtgggctcctcagcgtagcctcttggtgacagcatgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagcgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcagtgagaagtatatgtgggaggggagaggaatggggggtggggcagggttggtgatgagttctccatgtcccctgtgtttttctgcttctaatacaaagatttgtaatttgtttttgctttttggtagagacagggtctcgctaggttgcccaggctgctctcaaactccaggcctcaagtgaacctcctgccttgccctctcaacgtgctgggagccactgtgcccaatcaacacacagtaaaggggaagctcatttccagtatttgtgcaaagaaaaagacatcctttaagaagctatcgcagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcaagacacttcctaaatatattcgttatttccatcgtc

SEQ ID NO: 374037 - DNA, 6276 bp, Homo sapiens
  misc_feature (5618)..(5618): n is a, c, g, or t
  misc_feature (5940)..(5941): n is a, c, g, or t
  misc_feature (6020)..(6020): n is a, c, g, or t
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtgacagagtctcactctgttgcccaggctgaagtgcagtggcacaatctcggttcactgcaagctccacctcccaggttcaagccattctcctgcctcagcctacccagtagctgggactacaggcgcccgccaccacacccagctaattttttgtatttctactagagacgaggtttcactgtgttagtcaggatggtctcaatctcctgacctcgtgatccgccccacctcagcctcccaaagtgctgagattacaggtgtgagccaccgcgcccagctaattttttgtatttctagtagagacggggtttcaccgtgttagccaggatggtctcaacctcctgacctcgtgatctgcctcagcctcccaaagtgctgggattcaggcgtgagccacggcgccaggccatcttcactatctttgcactgaatttcgctctgtgtctattcattgactggttgaaatatccctcatttttaacagtcttttttttttttccaaataacaaacatggaaataaactctgaaacctgtaacaaaagtattcaaattttgaaagattgcttctcaacatcccagaagtgagaattcaaacttcccttaaccagaaagatgagactaaaacctattccaccgtcaacaaacttctagttcaaacctttcgaggtaaactaaggttccacgtactggcattgcatgtgtaccattaccgctaaaccgcaatcctattgtaaggatgatcacactcacaaatcctctcaaaccattcataacatctactgaaagggaaagggaaagggaaaaggtgtttcagaaacaacactcatcacctgatccttccctatcaaatgtcatccaaaaattcctcaaagcattcttgcttcgataatctaaattcctaaatccaaaaataatttggtaggaggagaaaccaagtcctccctttcaaggctcaggcttggcaaataggattgattaatatacatacaccagacataaacatttcaattaaaacctattccttctaaaacattcatcatatttctaacacaaaatcagttgctttcgcttttaacaagataactgaaaccaatctgatgtcaattacagactgagctgtaaatcagaaccaagttaaaagctttacaagtattacaatctcaaaaatgttacttttatcttaccacataaataaaaatgtatctacattgtatctacaaagtgagaagcgtttcctatcagccctggcataaagaaatgtatttccccagaagcaaagatcccagaggaaactacctcctacgttacaaaaccagggtctgggtttgggtccaaatcattatttgatatctttatacaaaaaaacaaaaccttctcttaagacaaaagttgggccatgcaacaactatgggctctcaaagtaaattttagtttaaaaaaattacctattgtttgcatggattttaccgatgactttatggctgcgcatctgccataaagtgttcaaaacgctcattctctctttgaaaggacctgaccaaaccaggactttggagttctcacccgactgagccactgaacagaaaaatccaggggaaaatccctgacggggattagaatgaactttttagtttccttccagagctggaaatattcgagtttggaaagtcccggagcagagccgcatttgcaacacggccatcctgctttagggatgaattgaaactggaaagagagtagtaccaatgagagtgagaaagggaagacgaggatgcagcctggtccagaacctctggagcccggggggaaacaggttggcatcacatccgcgccaccaagtcgcaggcccgcggcagagcgttgcgctcacccttgaaggtggcactacagagccacccaggaaacacggacttttcattgaagacaaaatgaatcaaggagcctgcgtgtgggcagcttccaaagcctccagtgagtgtgggagtagggatcagagcctcacggcgctctgggttgctgagtgtgggggtgatggtgaaacaaaatgcagaaaaggtaaaaattgaagaagcagagttaaaagtagctagcggtctggcctaagagacaggaagtggcccagactgagactgaagagggctggaccagggggaagtgaagagagcaggactgggagcagctacaagataggattgaggaatttcaggctgaaggaaagaaagggtggaggccncgccagacagcagcgagggggcggggctaggcaggaatgagggcggggcttgaaagtgaggggcggggctaggggaagaagggaggaggacggtgtgggggggtgagggagaaacgaaagaggatgggggagtgagaagagggtgggtgggggcaggaggggagaagcaagggggcaagtggaaggggaggtagcaaatagcttggaagtggtgggaaagaccaggaggatgaggggagggagcaggtgggagggaaaacaggaaagcaagagagatgatgggaaagtggtgagaagtgagggatgggaccaggggaacagnngcaaggccaggagggaaaagcgagggggcaggtgggcggagaggatgggaagcgaggagaaggagggagggggtaaaancggcggaggagaaaaaaaggagagaagcaagggggcgggaccaggaagaagtgagggccgatgctaggaaagaagtgaggaggcgggaccaggaagaagtgagggcccaggctaggaaagaagtgaggaggcgggaccagagagaagcgagggagctggacgcagggagaagcgagggggcggggacagaaagttaggaggcgggagcagagaggagcgagggggtggggccagagagatgggcggggtcaggttt

SEQ ID NO: 374038 - DNA, 4540 bp, Homo sapiens
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagagtctccagcgctgtaacttcggagcctcgggaggggcagccggggagtcagatgattgggaagacgaccgtactgaagagggattcgggggtcactgaacgtggtagctcgactggggtaccg

SEQ ID NO: 374039 - DNA, 520 bp, Homo sapiens
accctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgaggtaggaagactcggctcacatctgtggccgggggcagctgtgggttttctgagttggggctccaaagccaggaggtgttcacacacactgagatgaattggaaatctccagcacaaacctgcttctgatctccaggaagaaaataaagacttcagggcaagcgttcatctaaagcgtttttgggctgatttaaaatcctgtgtcagaaagttgaatagtatatttttgtaggtgaagattcattttttcttcaaatataaaaaagtttgaattctgtctgcgtgccctagaaaataaaactgtggacttgtca

SEQ ID NO: 374040 - DNA, 823 bp, Homo sapiens
gaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttctcaatacgaggaaataagacatcacccagagcacatttttcagttctggaaacatgttttgacaaatcacaggtgccaactatagatcaggactatgcttctgcctttgaacctatgaatgaatggggaggcgaaatttagctggaaaaagaggataatgtaaagagctatatggatatggcagcgcagggcatcaccagaccttagtactggctattgggaaacttttctccaaaggcagtacaagattccctgtctagaagtcgatgtgaatgatattgatgttgtaggccaggatatgcttgagattcta

SEQ ID NO: 374041 - DNA, 395 bp, Homo sapiens
gaggttatgttgataccagctattccatccaataggaaatagaatccgtggtatgcctttcaaaagatgttatgttatcaaatattattccacacctttaattcttaattttaaacctctagagcagggcacagtggtgtgtgcctctagtctcagccactggtaagtctgaagtaggaggatcacttgagcccaggtgttcaaggctgcagtgagctatgactgcaccagtgcacttcaacctgggcaacagagtgagaccctgtcttcactaaatttacacttctagaaaattgagtcttcttaaaacagctgaaactgtgacagtttttcagtaaacagttaagtcatagcctctttctattactaggggattaaacattattaatatttgc

SEQ ID NO: 374042 - DNA, 460 bp, Homo sapiens
ttcatgcttttaaatgtgtatatatgttatgcccttacgtgtatggaacgctccttgagaatggggactgttagtgtcttacatagatagtagcttgtgcatgaaaggcattcagtacatgattaaagattatgatgactgattttccaccacagaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggtaagatttcaaattcctcagaaaaatatttttgccatgcattaactttattttactcattaaatataaatgcatgtagaccctaaaagaagaaaagtttgcttaacaggccaggtgtagtggctcaggcct

SEQ ID NO: 374043 - DNA, 3962 bp, Homo sapiens
agacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcacgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaactagtgtgttttcattatgtttttaaaccttatatcctgaattctatttgttgttgttgttttaattagtagtctttaaaaaaagcagttttagggccag

SEQ ID NO: 374044 - DNA, 3900 bp, Homo sapiens
agacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcacgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaactagtgtgttttcattatgtttttaaaccttatatcctgaattctatttgttgttgttgttttaattagtagtctttaaaaaaagcagttttagggccag

SEQ ID NO: 374045 - DNA, 1656 bp, Homo sapiens
agacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactgtgagtagccagtcatgacacttgcaatgaaatagtttgactcgtgcaattaagatttttttcgaggcatttctaataatgttggaaaagatataaaagatttttctttgttaaagaccctgagtcctctggttggagcttgacatgagatcacttaaaattctaatatggtttataaaaagaaaaactttcaggataaaagtaaccaagtttacatgctacagtcttcagtcttttttctttttctttttt

SEQ ID NO: 374046 - DNA, 168 bp, Homo sapiens
gtgtgcttatgggcaagagtaatgaatccggggagctggtggccatcaaaaggtactgtgtgtgacactgccaacttcacctttgaaaactctgctctttattttcctgtcctcgcttaagaatatataccagcacaggccagcgcggtggctcatgcctgtaatccc

SEQ ID NO: 374047 - DNA, 378 bp, Homo sapiens
tataaatcaaataaagctatgtttaaacgtaatgatttactgtatttttttttctccgtatatcatcaaggcttttttcatagggacatgaaaccagaaaacttgctttgtatgggtccagagcttgtgaaaattgctgattttggacttgcaagagaattaaggtcacagccaccatacactgattatgtatctaccagatggtgagtaggggttatgcagccctcctgaggcataagcctatggtgaaattttcctacgatggattgttacatatttctggaagttccatattgaatatttaaaacacagaattgaattttatattctttaaagaaagcgaaggattggtttattgctattctgatcactgaaaaa

SEQ ID NO: 374048 - DNA, 4067 bp, Homo sapiens
atccccagcgggctgcagggccaccaccctctgtccgacccagccggagcccgacctgcgaggctggccgggcatgtcccctcggcgccctgtgctaccagggccaatctccgcccggagaccggtccctgacgccgggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgttcaaatttatattcaacaaggaagtcatttcaatcaacaacttctgctgcattatttttccaagatgaaccgatacacaaccatgagacagttgggggacggcacgtatgggagtgtgcttatgggcaagagtaatgaatccggggagctggtggccatcaaaaggatgaagagaaagttctattcttgggatgaatgcatgaacttgagagaagttaagtctctgaagaaacttaatcatgccaatgttattaaattgaaagaagttatcagagaaaatgaccatctttattttatatttgaatatatgaaagaaaacctctatcaattaatgaaagacagaaacaagttgttccctgaatcagtcatcagaaatattatgtatcaaatattgcaagggctggcttttatccataaacatggcttttttcatagggacatgaaaccagaaaacttgctttgtatgggtccagagcttgtgaaaattgctgattttggacttgcaagagaattaaggtcacagccaccatacactgattatgtatctaccagatggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcacgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacagaaagattgcaattatttgtttttctactttgaagctatgggagcgatggtaatttcaatcttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaactagtgtgttttcattatgtttttaaaccttatatcctgaattctatttgttgttgttgttttaattagtagtctttaaaaaaagcagttttagggccag

SEQ ID NO: 374049 - DNA, 3443 bp, Homo sapiens
cttaatatatcagatggcacttatttccatatctattcagttgagttcctgtcttaggcttgatggacatttcatagacatttgtctccagccccactcattgtctgtgatcagggaacatgtgttgtgtcctattatccccagaacattgtacaaatgcctgacacacagatggaacagggtctgaatacctgttccttgatggaaatgcatgaccacacagcgtagaatgctactgcccatccacctttgaaattgcaatcaaaattacctcttttgttctctattttcataggtatcgtgcccctgaagttttactgagatcttcagtttatagttctcccattgatgtgtgggctgttggaagtatcatggctgaactctatatgttaaggccacttttcccagggacaagtgaggtcgatgaaatctttaaaatttgccaagttttagggactcccaaaaaaagtgactggccagaaggataccagctggcatcctctatgaacttccgttttccccagtgtgttcctataaacttaaaaactcttattcccaatgccagtaatgaagctattcagctcatgaccgaaatgttgaattgggatccaaagaaacgaccgacagcaagccaggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactaagccaaatggcacactgagtcataaaagtggtaggaggcgttggggtcagactatcttcaagtctggagatagctgggaagagttggaggactatgatttcggagcctcccattccaagaagccaagcatgggtgtttttaaagaaaaaaggaaaaaagattctccatttcggcttccagagccagtaccctcaggctccaaccactcgacaggggaaaacaagagcttacctgctgttacttccctaaaatctgattccgaattgtcaactgctccaacctctaaacagtactacttgaaacaatcaagatatcttccaggtgtgaatcccaagaaggtgtccttgatagccagtggaaaggaaataaacccccacacttggagcaaccagttattccccaagtcactgggacccgttggggcagaacttgctttcaaaaggagcaatgcaggaaatcttggaagttatgctacttacaatcagtcaggatatattccttcctttctcaaaaaagaagtgcagtcagctggccagaggatccacttagcacctctcaatgcaacggcttcagaatatacctggaacacaaaaactggtcgggggcagttttcaggacgtacttataatcctacagcaaaaaacctaaatattgtgaaccgtgcacagcccattccctcagtgcacgggaggacagactgggtggccaagtatggaggccaccggtaggagtctatggtgtgaaaccctacagcattgctccgtagagtacgtgcaagttccttgaccctgggaaatgtctacaaatgtctatttctactgagttctggaagaaatatgcaaaagtgggtacttggaagggcaaaaatcatcccctattttacttatttccaagaaatgcattttcttagcatcattgcccacagtgttgatatatgggtaggatgttacaaagtattgaataaactatttgccaaagtatgaagtatttgatctacaatttaataaatagtaaatccaataagaacccttaaaaaaaaacaacttccagaaaatgtttagagtgttttagttttcatttgttgtatgtgcccaaatggtttagtagttcttcactttgctgtggttggcttaagaggtttgtcttttgtttttgtacagcagttgggccaacctttgctggctgtcagctgtggttcttatttgactaaggctctgcgctgccattttgtcaatgacttgagcaggatatctttttttttttttttgaggcgatgtttcactcttgtgtccaggctggagtgcagtggcactatcttggcttactgcaacctccacctcctgggttcaagtgattctcctgcctcagcctcccgagtagctgggattagaggcgtgtgccaccatgcctggctaatttttgtagtattagtagagacagggtttcaccatgttggtcaggctcaggctggtctcaaactcctgacctcaggtgatccacctgcctcggcctcccaaagtgcagggcttacaggtgtgagccacagtgcccagctttttttttttttttttagaaataaatttatctttaacatagagaatatcaaagttatgccacttgattttagtggacggcttgtgttttgatcttgaccagtacagttcccatgaattcaaggtgacaatcaagcccaatggcttgatgacttcaatagtaaccaagtcaaggttctcttggctggacatcattaagaaagttctggaaactgtgtttgtttgatgctggttcattggacttttcaaattgttttgtttctgtgtccctaccagacacaaagatgaagtgtgccagctggttcccccaagccagctcatgctgctgaccactgactcagctctgaccttcacatttgctctgaagcaagtgcgttcagctgctggggcagtgatatcacatagtacatatattatttccttagtttatttccaaactggtattttaaatagacacttcgaactttgggctactctgtttaaatctgccactttctggactggaccttagtactgtaaattctttttaaagaataataatgttaccaactgctgagatttttatgtattttgtgactttgtaacaactgctattgtaataagtgtcatcttgtgggcattatacaaaggcatattataaaataataatgatatttttgtatagaagagtcaactgttcagatgtaagatgttgaaaaatgttaaaatctaaagagtaatttatcctagtggtaatggttatatgtatttgtacagtttaaattaatgtctcaaagctgtgcagtcttttgttactgggacacttttaaactctgaataggcattaaaaaaaatatggctaactagtgtgttttcattatgtttttaaaccttatatcctgaattctatttgttgttgttgttttaattagtagtctttaaaaaaagcagttttagggccag

SEQ ID NO: 374050 - DNA, 448 bp, Homo sapiens
cttgtgtcccctctgtcttctccagatgaaacattcctacttccttcctcaaatgatggggtcactgtctctcattattctagctgctttcctgtggacatgcctcaccctctcttaaaggatggccaataggctggatcacaaatctcctgcatggtttgacccgcaggactattactttctctgttctgaactggagttgcatcacactgttgactcatatggagcacaaagtcaactgaaaccacagcccttcttttttgacgtggtctactgatggtggtgagtcatctttctcccactttgtactcagtacttaagccaagatgtgttttctttgtttattttaagcccaagtatatccctgttaaattttatcctcctgttaagttttatggtctacctttcatttgccgagatcttttcatattctcagttctgattaaaa

SEQ ID NO: 374051 - DNA, 174 bp, Homo sapiens
gatttagaataaagccaaataaagcctgtgtttagaagttaaagtagcacaatttttatagaataagtatgatttgtttgcgatttggtaataaaataaacactcagagataaagcttagtgaaatgacctgtgatccaaaaggctgtgttatcatgcttttcaaatgttgtat

SEQ ID NO: 374052 - DNA, 1327 bp, Homo sapiens
cgcgcctccagcccagcgctcggagccgctttcgctgccactgtctgctcccccgggccgccgccgcctccccccgcaggcccggggctctgtccgctgggcccgcgctgctcgccccgagccaggagaacgagctcgaggaggatgcctgggcccgtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcaacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggtacaaaaaa

SEQ ID NO: 374053 - DNA, 1389 bp, Homo sapiens
cgcgcctccagcccagcgctcggagccgctttcgctgccactgtctgctcccccgggccgccgccgcctccccccgcaggcccggggctctgtccgctgggcccgcgctgctcgccccgagccaggagaacgagctcgaggaggatgcctgggcccgtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggtacaaaaaa

SEQ ID NO: 374054 - DNA, 715 bp, Homo sapiens
gcccaggccaaatgggagcgacccagcccattgtctggatcacaagtgcccctttcttgtctgagcacaatgccccaactgtactgagtagcatgcaggttggccggcagggaggcacgcgccacatggaggtgcctggtccgccaggggagctcctctgggaggagaatggcctctgactcagaggaaatgacctctggctcccctcccaacctcccctcagcgggcatcatgctggagagagaaatggccctcctgccagctctcccaggcctgactcagcagatgccagccccgaccgcgggcttcagatccaggatcccagcgaccacaaccgtccttgggtttcctttcccatccggggaggcatcctagaggtgactggcatctggggcattggaggccttggcataagatgcccttagatgggtggtgccctggaggtcaggcctgagtctcctgcaggcaggggcgcctggggaattactcacgggtgcctttcattcccttcctgctctgtgagacctgtgttgagtgctctgcatccattatctcctaatttttttttacaacagttgcgcaaggtaagtttattatccccattttagagatgaagactctaaagggaggctcagggaggtgagtgacttgcccaaggtcacactaccagtaagtggcagagctgagtctacactgcaggcttctctgggggcaa

SEQ ID NO: 374055 - DNA, 727 bp, Homo sapiens
ggcttccatccgcagcctccgggagaacacgggcggcggcgggctcgggttcgggctagggctggggcgcgggcggcccctggccggggcctctgcgagaggctgggaaccggcggcctcacctcctccgaccgcctcccactccgcagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggtacaaaaaagggtgcaccgg

SEQ ID NO: 374056 - DNA, 1352 bp, Homo sapiens
  misc_feature (35)..(35): n is a, c, g, or t
aaactgataaccggctaggtacgaggctgggtggngcattcccttcctgctctgtgagacctgtgttgagtgctctgcatccattatctcctaatttttttttacaacagttgcgcaaggtcccgcgcggccccgggtgaggcacgcccgcgcgcccgccggcgccatgggaaggagcgggcgccgctgctgtcccccgccggcgcgcgcacgacttgagacctgccacgggcagcccccggccgcgggtccccgagtgacgctggcggcacctgagagtgtggcgcgggcccggggccacgcagcggagcccagtgtccagtgaagcgtctgaggacccgccgcccgtgccgccgccatggtgatgtcccagggcacctacacgttcctcacgtgcttcgccggcttctggctcatctggggtctcatcgtcctgctctgctgcttctgcagcttcctgcgccgccgcctcaaacggcgccaggaggagcgactgcgcgagcagaacctgcgcgccctagagctggagcccctcgaactcgagggcagtctggccgggagccccccgggcctggcgccgccgcagccaccaccacaccgtagccgcctggaggcgccggctcacgcgcactcgcatccgcacgtgcacgtgcacccgctgctgcaccacgggcccgcgcagccgcacgcgcacgcgcacccacacccgcaccaccacgcgctcccgcacccgccgcctacgcacctgtcggtgccgccacggccctggagctacccgcgccaagcggaatcggacatgtccaaaccaccgtgttacgaagaggcggtgctgatggcagagccgccgccgccctatagcgaggtgctcacggacacgcgcggcctctaccgcaagatcgtcacgcccttcctgagtcgccgcgacagcgcggagaagcaggagcagccgcctcccagctacaagccgctcttcctggaccggggctacacctcggcgctgcacctgcccagcgcccctcggcccgcgccgccctgcccagccctctgcctgcaggccgaccgtggccgccgggtcttccccagctggaccgactcagagctcagcagccgcgagcccctggagcacggagcttggcgtctgccggtctccatccccttgttcgggaggactacagccgtatagaggggcgcccggcgccccgggccccaccggcggactcctggcctgactgcggggctttttaaatgcttccctggactgcggggaggggcggggggagggagggatttcttatcccgtttgttacattttgaggataataaaggtgtgtgatctggtttggtacaaaaaa

SEQ ID NO: 374057 - DNA, 388 bp, Homo sapiens
aataatccttgacagcagcaaccttttcacaaagttactttggaatgtggaatatctaaagagaaaataaagaaaataaacatctggaggcacacactgaaatatctgttcttctcaacttcatttataaagcttgacaaagataatagtctttcacaattactgctcctgatgggtgccagaattcttcgaaaatcaaaggcatggatctctgagtttaagatatctggattctctaacagttgcataagaatttctagagggacttcatcagaaatagacttcttaagcttccttttctgaatatgttttgggtcaataatacattattatttttccctctcagaagacagttcatagtgagagtccatctctacaaaaaaattaa

SEQ ID NO: 374058 - DNA, 1174 bp, Homo sapiens
ggcagagaggccgccgtagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 374059 - DNA, 412 bp, Homo sapiens
aagaaaggttgcaaagcatggccttagatgctagaatgcgacttgtgtggctctgattcggggttctttgtttccttgtcctaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 374060 - DNA, 1288 bp, Homo sapiens
ggcagagaggccgccgtagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcaggtaggcggggaagtcccagagctgctccaggggtgtcctttccagcgggctggggcgggccggcgggctggagtcggggtgcagccctcacggccctttgtcttcaccccgaagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 374061 - DNA, 827 bp, Homo sapiens
ggcagagaggccgccgtagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcaggtaggcggggaagtcccagagctgctccaggggtgtcctttccagcgggctggggcgggccggcgggctggagtcggggtgcagccctcacggccctttgtcttcaccccgaagctggaaggtgttccgctcccagtgcctgcaggtgccagagagagaggcgcaggacgctcaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 374062 - DNA, 305 bp, Homo sapiens
gaaagcagtaagcactgtttttgctttacctaattactttttcagcttataaggtaaaatcattccttttagtaacatcagtctcataactctttttgctggaagcctgaatatgtggtatttttcaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatcca

SEQ ID NO: 374063 - DNA, 1654 bp, Homo sapiens
ggcagagaggccgccgtagtttgcgttttcacctggtcgcccggcggccatggcggccgttctgaagccggtgctgctgggccttcgagatgcgccggtgcacggcagccccacagggccgggtgcctggactgctagcaagctgggcggcattccggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaacttttggcccgttttgcccaatcattttttaactcgggaaaatttttctatggggcccaaattggggcttatttgggcaatttcccctttaggggggtgttttaaaattaaatgggcgggtttttaaaaaggggtaattgggaaaaccctggggatacccaatttaaatcccttgggaaaaattccctttttcccaagtttgggtaaactaaaaaggccccacccgtaggccttttcaaaaaattggccactcttaaagggaaagggaaatttgggggccgaaattttggttaaaattcgggtgaaaaattttgtaaaatcgctttatttttaaccctgggcctgcggcccttt

SEQ ID NO: 374064 - DNA, 1218 bp, Homo sapiens
ccacgcgtcgatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaaggatgctctgcccaccgtggctgcgcccaggcccgtgtgtcagcgctgcgggcagccgctcgctctggtcgtgcaggtgtattgcccgctggaaggctccccgtttcaccgtctgctgcacgtgttcgcgtgcgcctgccccggctgtagcaccggcggtgcgcgcagctggaaggtgttccgctcccagtgcctgcaggtgccagagagagaggcgcaggacgctcagaaacagggaaacagccttgcagctgaggactggtgtgaaggtgctgatgactggggaagtgatactgaggaggggccttcaccacagtttaccttggattttgggaatgatgccagcagtgccaaagacgtagactggactgctcggctccaagacctccgcctgcaggatgctgtcctgggtgctgcccatcctgtgcctcctgggctgccgctcttcctgccctactacatctgtgttgcagatgaggatgattacagggactttgtcaacctggatcatgcccacagccttctgagggactatcagcagagagaaggcattgccatggatcagttgctttcccaaagccttcctaatgatggtgatgaaaaatatgagaagaccataattaaaagtggagatcagacgttttacaaattcatgaagcgaattgctgcttgtcaggagcagattttgaggtattcctggagtggagagccactctttttgacctgccctacatcagaagtcaccgagctcccagcctgcagccagtgtggaggccaaaggatatttgagtttcagcttatgccagcactggtcagcatgctcaagagtgctaatttaggtctttctgtggaatttggaacaattctagtttacacatgtgagaagagttgctggcccccaaatcatcagactcccatggaagaattttgtattatacaagaagacccagatgaattattgtttaagtagagcatttccttttattaatataaattaaaacaaatgtttacatccaaa

SEQ ID NO: 374065 - DNA, 2528 bp, Homo sapiens
acacacactcagaggagagaggaagaattgaaagacttgagaagactttgataacctccctgctggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatattgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgccacaagatctctggtgtatgatcacggaacacttgacattcttatcaccactgtaaaggatacaggtgcttttacctgccttgcttcccatcctgctggggaagcacacctaatagtggatcttcatataattaagatcccgatgacttactaaatagtac

SEQ ID NO: 374066 - DNA, 2551 bp, Homo sapiens
acacacactcagaggagagaggaagaattgaaagacttgagaagactttgataacctccctgctggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatattgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgccacaagatctctggtgtatgatcacggaacacttgacattcttatcaccactgtaaaggatacaggtgcttttacctgccttgcttcccatcctgctggggaagcacacctaatagtggatcttcatataattaagatcccgatgacttactaaatagtac

SEQ ID NO: 374067 - DNA, 873 bp, Homo sapiens
  misc_feature (516)..(516): n is a, c, g, or t
  misc_feature (552)..(552): n is a, c, g, or t
  misc_feature (568)..(568): n is a, c, g, or t
  misc_feature (571)..(571): n is a, c, g, or t
  misc_feature (606)..(606): n is a, c, g, or t
  misc_feature (652)..(652): n is a, c, g, or t
  misc_feature (654)..(654): n is a, c, g, or t
  misc_feature (668)..(668): n is a, c, g, or t
  misc_feature (671)..(671): n is a, c, g, or t
  misc_feature (674)..(675): n is a, c, g, or t
  misc_feature (681)..(681): n is a, c, g, or t
  misc_feature (873)..(873): n is a, c, g, or t
ggccatctgcacggcagacggcaccatgaggcttggggagcccacctccaatgagactctgtcctgcgtcatcatctttgtcatcgtgtactacgccctgatggctggtgtggtacaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtggcagccttctcactcagcagcccggggtggttgtcttgatgaatcaccatggggntgggaccctgtacacgtatcctgaaaactggagggncttaaggtctcatcgntgntcagtacagggggctcaggtccgcgtgctctccgnagccacccacttccattttggccaaacaacggaccctgaattctcngnaattcctgcggganggnccnncattgngggagatggctcggggtctgaaacaccgctgcctatatgtggaagggcgcgggggagacccaagagcccgggggagggggccggggcccaattgccccacacgggggcccggtgtcccacaaaggaaggagggcgcgggggcttcaccggcagcgaaaccgggaaccaccccctggggcgacaacatggccn

SEQ ID NO: 374068 - DNA, 3999 bp, Homo sapiens
  misc_feature (4)..(4): n is a, c, g, or t
  misc_feature (6)..(8): n is a, c, g, or t
ggcncnnnggggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccaggtatgagagttcaagcttctggaggaaggtggggggagcacagaggctgggggcttctgggactggagtacaggggctgtcggaggaggaggaagaggaaggaaaggccccagaggatctgaagagtggggctgaggctctaagagtctagagacctgggccccagaactaacaggttaagtgctcccaggggagcgggggtggcatggacagagccagggccccaggctcgtgttgtctctcctcctgtcagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374069 - DNA, 3637 bp, Homo sapiens
  misc_feature (4)..(4): n is a, c, g, or t
  misc_feature (6)..(8): n is a, c, g, or t
ggcncnnnggggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctggatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374070 - DNA, 3874 bp, Homo sapiens
  misc_feature (4)..(4): n is a, c, g, or t
  misc_feature (6)..(8): n is a, c, g, or t
ggcncnnnggggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggttgctctccctgggcaagagtaagtcagggttccaagaactggatttctggcctccagttaggccctttggggacgtgaggcccttctcttcagattctgaaggggtagagatcaccgtggttacaggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374071 - DNA, 3746 bp, Homo sapiens
  misc_feature (4)..(4): n is a, c, g, or t
  misc_feature (6)..(8): n is a, c, g, or t
ggcncnnnggggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374072 - DNA, 3541 bp, Homo sapiens
gcgagctagagcaacaaaggagccgggtcgccggcggggagagttcggggggctgcggcgcgctggggcgaaggtggctgctgggccgcgggctggcgcgggggcggagccggaactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccaggtatgagagttcaagcttctggaggaaggtggggggagcacagaggctgggggcttctgggactggagtacaggggctgtcggaggaggaggaagaggaaggaaaggccccagaggatctgaagagtggggctgaggctctaagagtctagagacctgggccccagaactaacaggttaagtgctcccaggggagcgggggtggcatggacagagccagggccccaggctcgtgttgtctctcctcctgtcagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374073 - DNA, 3679 bp, Homo sapiens
  misc_feature (4)..(4): n is a, c, g, or t
  misc_feature (6)..(8): n is a, c, g, or t
ggcncnnnggggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataa

SEQ ID NO: 374074 - DNA, 380 bp, Homo sapiens
cagattaagtgtctggtgagagtctacttaccgatttcataaacagccattttttctctgtgtcctcacgtggtggaagggacaagggacctctcttcaggcctctttcataagggcactaatctctttcatgaggccagatccctcatgacctaatcacctgctaaaggccccacctccaaataccatcatcctggaggtcaggattttaacaaatgaattctggagggatatagacatttagaccctagcacatactgatataacatcaaatggtgatagatcagtatccgtagtctccttttatatacttgaatacagtagagtctcctcaaatacacttaaatcataaaaactcaactgtatatgcttggaacaaa

SEQ ID NO: 374075 - DNA, 498 bp, Homo sapiens
tttaatatttaattcatttaatccttacagaaaccctgtgacataggtactataatgattcccactttaaatataagaaaactgagacccaaagaggctaagcgacttgtccaaggtcacgctgctagcatgtggcttctggctcaagtccacagccctaacactacaatctgctgcttctctataggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgagtttgcaggctgggcaccgtgcctcctctgggaggggagtgtgggtggcgagcacagggacagcacaggacacatcccctt

SEQ ID NO: 374076 - DNA, 3120 bp, Homo sapiens
ctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgtatctttgtgtatatatgt

SEQ ID NO: 374077 - DNA, 2929 bp, Homo sapiens
ctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgtatctttgtgtatatatgt

SEQ ID NO: 374078 - DNA, 2926 bp, Homo sapiens
gctgtacagacaatactatttaatgtccattgtgaatttctacatggcaggcctcatgttaactgttccacatgtattatctcatttaatcttcacgcagttcttttatagggaaggaaactgaggctcagggggataagtgacttgcccaacatcacatagctagtaagaggtaaaatcaatgtgacttcacagctgctggaacccctgtgctatagggctgtctgtgtccccctggaggacagactgctctcagcctgcacctcccatcccttctccaggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggctcttggcactgtgcttaaggggcctggtggctgaacttgctctggtgatggaggactttgaccttctgcacgtcctctagcgagctctctggcaagcatgcagagtgtctgacattcttctcctgctttggtaacaatttcatcttcttaaaggcaaagaaagcctgcacgggccaagctgtgaagccaagagggttggaagacaaatatatatgtgtgtgtatctttgtgtatatatgt

SEQ ID NO: 374079 - DNA, 915 bp, Homo sapiens
gtatgggtgaagaggcagggagcaggggtgaccagcctggggaggtgggcagtgaagtgagggcaccaacaggccaatatcaccctacgagttgcaaagtgcctgtcttctcagctgccctccccagtgctggccactgacccacaggtggggtgtatgtcatagtgtgtgggcttcagggactagcctgaccagtgcatttcaaactatgcgacggaaagactctgaggacccacacctgaaaacttataacctttctaccctgagcatcgatttggcatctgccgttggtctgtcctataaacaagcctgaacctccccaccatgtgacctgcaggctctggagacactgtgaacctctggggcgctaaaaggaccctggtccacacctacccttgcatgtcctagatcagggcttctgccccagggcctgttccttgaaggacaggggccgccctgggaacctcttccagcagctcctcggccagaggagccccaaggaagtgagattcagactcagtgttggaggggagatgaggagggcagtgacacactcgatttgagaagggaaggagacaaagctcacttgggcctgatggctctggagagtctcttgcatctcaatctctctctgttgcttttcacattctccaaactccccactcccagccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggcttt

SEQ ID NO: 374080 - DNA, 2933 bp, Homo sapiens
ctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaaggtgcgaggctgatggtcaatgtggattctccccaataaatctctctccaggcttt

SEQ ID NO: 374081 - DNA, 3060 bp, Homo sapiens
ctggtgtttggcagttaccagaggagctgtgcctgggcagagggtacccaggagacaccctggtgcccttaacctccaaagcaggcaacattgtgtgtccaggcctgtggaccagaaacacaggatgttttgtgactgacagagtgatccaaaatggagaaggatgaccccccacagttggtgactcccacatcagtgaaagccatcatcctgaggattgaggctgcccagctaactcgggctcaagaggatatttctacccagctctcagacattttggacaatgtcaattgtgtcatcaaccgcttccaggaagaattaggatatgatttaaaagaaaatgccaaatctcagcagagagatccaaagggcaagaagagattcatcttgctggaaaaaattgcctccttctccaaagatgctatgatgaaggagaagcacctgtatgacattctccgctggctgggtgactggggtgacactctgacctatgagattgggcccaggaagagtgaagaggaagcagcagctctggacgaatggattgaagtgacggagaaagtgttaccgctgtccctcattgccaccaaaagaggcatcgagtcactcactgccctttgctccactctcattgaaggacaaaagaaaaggtcacaagtgtccaaacgcaccttctggcagggctggcagggaagaagcccacagacatctccatcccatcctcagccactaagcccagaacagatgctccaggaccagcataccatgaacacgaaggcctcggaggtgacgtccatgctgcaggagctcctggactctaccatgttcagcaagggggaggtcagggccatcaggtacatggccactgtggtggagaacctcaacaaggccttgatcctccaacacaaggagaacaggagcctggagaccaaatacaggcacctgcaaatgcaggcgaccaaagagctcagcagccagaggctgcacttccagcagttcatggaggtccttgagagcaggagggatgctctgctgaagcaggtagagatcttagggggaaggtaccatgaccttctcctgatgaagcaggccttggagttccagctgaagaaggctcagaatgctacaggtcaggcagaagacctggctgaggtttctgttgactccccaggtccctctgagagagagaccctcccaaggaaagaaacagtcatggaggaaagccaacaggaaccgatgaaggaggagcagttgttctcgccacttcccccaagtcccatggccatgatacgggacagtggtgctatagctgcagggcaccagccactttccaccatgactgtgcgctcgagggtcgcagatgtgttcggcagcaaggacactgagagccttgagcctgtgcttttacccttagtagatcgcaggtttcctaagaaatgggaaagaccggtggcagaaagcttaggccacaaagacaaagaccaggaggactacttccagaagggaggactccaaattaagttccactgtagcaagcagctgtctctagagagctccaggcaggtgacctctgagagccaagaggagccctgggaggaggaattcggccgggagatgcggaggcagctgtggctggaggaggaggagatgtggcagcagcggcagaagaagtgggccctgctggagcaggagcatcaggagaagctgcggcagtggaatctggaagacctggccagggagcaacagcggagatgggtccagctagaaaaggagcaggagagcccacggagagagccagagcagctaggggaggatgtggagaggaggatcttcacacccaccagtcgatggagggacttggagaaggcagagctatcattagtgcctgccccaagccggacccaatctgctcaccaaagcaggaggccacacttgcccatgtctcctagtacccagcagcctgccctgggaaagcagagacctatgagttcagtggagtttacctacagaccacggacccgccgagttcccacaaagcccaagaaatctgcctcctttcctgtcactgggacatccatccgaaggctgacctggccctctttgcagatatcccctgcaaatattaagaagaaggtgtaccacatggacatggaggcccagaggaagaacctgcagctcctgagtgaggagtctgagttgaggctgccccactacctgcgcagcaaagcactggagctcaccaccaccaccatggagctgggcgcgctcaggctgcagtacctgtgccataagtacatcttctatagacgcctccagagcctccggcaagaagcgatcaaccatgtacaaatcatgaaagaaacggaggcttcctacaaggcccagaacctctacatcttcctggaaaacattgaccgcctgcagagtctcaggctgcaggcctggacggacaagcagaaggggctggaggagaagcaccgagagtgcctgagcagcatggtgaccatgttccccaagctccagctggagtggaacgttcacctgaacatccctgaggtcacctcgccaaagccaaagaaatgcaagttgcctgcagcctcaccccggcacatccgccccagtggccccacctacaagcagccctttctgtctaggcaccgggcatgtgtgcccctgcagatggcccgccaacaggggaagcagatggaggctgtctggaagaccgaggtggcctcctccagttacgcaatagaaaaaaagacccctgccagccttccccgggaccagctgaggggacacccagatattccccggctgttgacactggacgtgtagtcctcctgccacaaaagcctgaacttcctgaaggcccagtaagcgcctcagcgaaccaaaggaaggaatgccaggaacctacaaatgaatccgcttagcttgttcaaaaaaagtcaagcgagtcactccctggaacccaaataagccagaaggatcaagacagccccagtctccactgcatccctcagccagtgattctcaaccttctgagggacggaaacccac

SEQ ID NO: 374082 - DNA, 1935 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaacta

SEQ ID NO: 374083 - DNA, 274 bp, Homo sapiens
atcatactcaggatcccagttaacaattgtgtattttcttttgtaacaggttgtttctcccaaagaagagaacaaagcagcagaaccaccaccacctaaaatccccaaaattgagaccactcatccaccgttgcctccagcccacccacctccagaccggaagcctcccctcgctgctgccttaggtgaggctgagccgccgggccctgtggatgccactgacctccccaaagtccagattccccctccggcccacccggcccctgtgcaccag

SEQ ID NO: 374084 - DNA, 3558 bp, Homo sapiens
aggtccccgacattccatatacaagatggccgcagtcggcaaggagagacgtcgctgaggggcttgcctgaagcgaggggtgagtgacccaccgactgagggcagcgccgcccacctcccgcgtatctggaggtcggagtaggttatggccaaccgccgctatccactggcggagtctctctttccggattctgcctccctccgctaacctccggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374085 - DNA, 3419 bp, Homo sapiens
caggttttgctgaagaatggaatctggaccagcgttagaggacctgtatgtctagtgaagaaaaaccagaagaaagattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374086 - DNA, 3101 bp, Homo sapiens
tgatatcggggaaccggccctcggggaataattgggggtgcatcgctgtctatatgtttcatgcgcgtgcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374087 - DNA, 3366 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatattttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374088 - DNA, 1362 bp, Homo sapiens
aggtccccgacattccatatacaagatggccgcagtcggcaaggagagacgtcgctgaggggcttgcctgaagcgaggggtgagtgacccaccgactgagggcagcgccgcccacctcccgcgtatctggaggtcggagtaggttatggccaaccgccgctatccactggcggagtctctctttccggattctgcctccctccgctaacctccggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcagaaccagccccaagccagcacctttggtaaataaagcagcatctgagatttt

SEQ ID NO: 374089 - DNA, 2388 bp, Homo sapiens
ctacaaccccaacttcccacccccacccccacgcctcccgcctacccacgcagtcccccctcactcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374090 - DNA, 1367 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcagaaccaccaccacctaaaatccccaaaattgagaccactcatccaccgttgcctccagcccacccacctccagaccggaagcctcccctcgctgctgccttaggtgaggctgagccgccgggccctgtggatgccactgacctccccaaagtccagattccccctccggcccacccggcccctgtgcaccag

SEQ ID NO: 374091 - DNA, 1084 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccaatgctattgaaacttctaaaactaggggtt

SEQ ID NO: 374092 - DNA, 1382 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatcaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374093 - DNA, 691 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaagtgtgataagtacaaaattcaataagatagttgtaaaaggcggg

SEQ ID NO: 374094 - DNA, 493 bp, Homo sapiens
cctagttttagaagtttcaatagcagttcctactcatatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccaatgctattgaaacttctaaaactaggggtt

SEQ ID NO: 374095 - DNA, 3423 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374096 - DNA, 3414 bp, Homo sapiens
ttcttaaaatctaaaccctttaaaatcagtaaggggacttggtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374097 - DNA, 4701 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtaagaagaaagttttcagaagaattttttcattctgaaatcaagtctttataatttgatgacactcaaattacgcttctcaaaagcggaaaacaaagtttgatgtgtgaaataccaagggcatggcttgctcagtcaattcagcattgcagctgctaatgctgtttccttttatgtataaacaggctctgtcatccagttgccaagtgatgggagaggcaggaaaatgaggcagaattttttaaatggactaataaacttagccttggagccaggttttccatacatggtggttcagcgtaggtcatgaggaggaagaaggggtaggatgtggacccacatcattcatccttgtttcccacgcaaaagctctttgctgtgtatttgagtggtgctgaacacgtggtaggtttttaataaatacttgatgctgcctgtgaatttttctattgctattaatttacctttttgtccccatttctaggtgataaaaacaaaattcaaaagttggttcaaatggcatggacatttgtaaatgacaggtatacatgttcaaatgttgattaattacagtattttaaaataggcagagactttatggaccatttcatctaaacccctcattttgtgtcagaagaaactgacttgccctggcttgaggagccagttaatggcaaagctggggctgacgtccaggtcatctgcttcccggcagagggtttccttctgccctgccgtgtcatggtgttgtgaggtgctgaaattttatcaccagtctgaaacataagtccaaaacaatacactggagaattttgaaaactaattacttagagcccatttggttttgcaaaaatatacttcctggtatagttttagagccttaacactcttttgagaggccagggatctaatgaggggccgtggtgggaaacagaatgcctgtgaatggagttgctgccagccccatcccactgcagtcagtgaagcttctcttacatttgacttcctccataagatttcatttgaagaaacagttgagtggctaggatttcaccagtttaaataacataagtcattttcattggtgtagcaatttttggatgtgctagaattcttctgattctttaaggaatagagaaattactaactatggttaaagtaacttagtcgggtacctttagaagagtaaagacttgagtttatttatttatagtactttaattaaatttaggggagaataagcaaattaatggttagttatggcatctccatgcactggtttaatcataaatattagatcatattatctaaccttttttttttcttgttgaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374098 - DNA, 2639 bp, Homo sapiens
ttagtcagttcttggcctcaccctgagggcaggaaaggaatccatgagcagagacggtggccaagggcctggggctgagcaacgtttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggaccccccccctcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaatcagtagtatgtatcttgtttcctcaagtttcaagaaaaaaaaaatgaaaggtcacttttttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcacgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcag

SEQ ID NO: 374099 - DNA, 1521 bp, Homo sapiens
aggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcaggtaatttcctgttctgatgtttttttagttttatgtgtttatatgcaaaactttaaattcttagccaacattgtttcttttcagatctaaattggccttaaatcttaactttagagctcatacaaaacttttccatcagcattgtctttctgttcatcacctgatcatagattctaaaattgtgctcttacgaagctatcagtacagaaaacattactggcaataaaaatgtactcagtaacatatataaaagtataattatggctgtaggagaactgttgctgcaattttatttttagagactatttacccccatcacagcagcaggagtcctctcccaagcac

SEQ ID NO: 374100 - DNA, 253 bp, Homo sapiens
attcatgtgaagaagtatgagtggttttctaatctgctttttctttgtagaaccaccaccacctaaaatccccaaaattgagaccactcatccaccgttgcctccagcccacccacctccaggtaagcatctgctgaagcagcttggccagctgtgcacatcgcctctgaatgttggacgcagcaggtcctgggaacttagaaaagggagactggggcccagattgacaatgtcagccacaggcaggaatctt

SEQ ID NO: 374101 - DNA, 248 bp, Homo sapiens
gtatctgggactacaggcacacaccatcatgcctgcctaatttttgtatttttagtagagacagggtttcttcatgttggccaggctggtctcaaactccagacctcaggtgatctgcctgccttggcttcccaaagtgctaggattacaggcatgagccactacacctggcctgttatatgtattttctgattataaaagtaacaggcatagctgcagtattcacaattgctaaaagatggatacaa

SEQ ID NO: 374102 - DNA, 3246 bp, Homo sapiens
acgtctacccattcttatttctgcagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccattatgtgggccattactgaattctgacatctttagcgactgggcagccaactgggatggctccttgtgctttgcaacatacatagttaaccaacaaagacaataaaagagaagtgatgcccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaatg

SEQ ID NO: 374103 - DNA, 3249 bp, Homo sapiens
  misc_feature (105)..(106): n is a, c, g, or t
  misc_feature (151)..(151): n is a, c, g, or t
aatatcaacctgtttcctcctcctccttctcctcctcctccgtgacctcctcctcctctttctcctgagaaacttcgccccagcggtgcggcagcgccctgccgnngccggggagggacgcaggcaggcggcgggcagcgggaggcggcancccggtgcgtccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagagaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaatg

SEQ ID NO: 374104 - DNA, 1450 bp, Homo sapiens
ggcgcggtgaccggacagaccctcgcgaaggagttctaaggcgaagtccatggagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccatgctaccagtaagactgtcatcatgtgcttgaatgaggggatagcagctttgcctcagtttacctaagcgctcttctcttctaaatattacacttagcaaggctccatatatccattcagaatgtctcaacacaagaagttgcttgtagtaaaatgtagttggtatcagattatatgctgattaaattggaagcagtctttttgtaattgcaataaaaatgcaatatccacttatgattgttatcatcaatttttttcttcagaaggactataatcagtttaaagactagcaaagataaaatgaatgaaaatctgcattttctacagagctatgtatctatatggtaccattttggtttttttctattattttgttaacctatattttcatattttataatttcagacatgatttgatgcatgttcagtatatacatgtaaaaggttatatataaaacctcttcataaat

SEQ ID NO: 374105 - DNA, 1101 bp, Homo sapiens
  misc_feature (105)..(106): n is a, c, g, or t
  misc_feature (151)..(151): n is a, c, g, or t
aatatcaacctgtttcctcctcctccttctcctcctcctccgtgacctcctcctcctctttctcctgagaaacttcgccccagcggtgcggcagcgccctgccgnngccggggagggacgcaggcaggcggcgggcagcgggaggcggcancccggtgcgtccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttctctctgttggccttggggttcaggggggcctcggtcagcagcactgggtgctcctccggggccacgcgcagctcgttgtagaaggtgtggtgccagatcttctccatgtcgtcccagttggtgacgatgccatgctcaatggggtacttcagggtcaggatgccacgcttgctctgggcctcgtcgcccacgtaggagtccatctggcccatgcccaccatgacgccctggtgtctaaagcgcccgacgatggaaggaaacacggctcggggagcgtcgtcgaaccaatatcg

SEQ ID NO: 374106 - DNA, 428 bp, Homo sapiens
attttataatatattttttattgtttttttcattgtgtttttctctaattaaggaacacttcccaaaatttaaagtgctcatcaacacctcccaaggatttttcaccatgttcctttagctgtttagccattttaaaggcctggctaaatttcacattaaaaggttttaaaaatttgtttagtgtattttatcagtaaagtgttttttttctctcagtcccagaacgaaacctcaggaagccaagtcccctgaagcatatgtagccctgaatgacgtggcctttgttttgtcttttgcatctaggtctccagtcatgttccataccctgtagcgttacatgtaaatatagtcaatgtccctcagccagctgccgcagccattcaggtaagatcattgatcattcactgttcaaagcaccacttttaag

SEQ ID NO: 374107 - DNA, 3321 bp, Homo sapiens
  misc_feature (105)..(106): n is a, c, g, or t
  misc_feature (151)..(151): n is a, c, g, or t
aatatcaacctgtttcctcctcctccttctcctcctcctccgtgacctcctcctcctctttctcctgagaaacttcgccccagcggtgcggcagcgccctgccgnngccggggagggacgcaggcaggcggcgggcagcgggaggcggcancccggtgcgtccccgcggctctcggcggagccccgccgcccgccgcgccatggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaatg

SEQ ID NO: 374108 - DNA, 3153 bp, Homo sapiens
ggcgcggtgaccggacagaccctcgcgaaggagttctaaggcgaagtccatggagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaatg

SEQ ID NO: 374109 - DNA, 2293 bp, Homo sapiens
  misc_feature (1)..(3): n is a, c, g, or t
  misc_feature (6)..(6): n is a, c, g, or t
  misc_feature (8)..(8): n is a, c, g, or t
  misc_feature (12)..(12): n is a, c, g, or t
  misc_feature (106)..(106): n is a, c, g, or t
nnnatngnttcngattcttcatcatggtgtgatctcagcagttttgaattctttgaagaagcagatttttcacctagccaacatcacacaggcaaagccctacagnttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcatttagttgaatgaagtcttcttggatttcacccaactaaaaggatttttaaaaataaataacagtcttacctaaattattaggtaatgaattgtagccagttgttaatatcttaatgcagatttttttaaaaaaaacataaaatgatttatctgtattttaaaggatccaacagatcagtattttttcctgtgatgggttttttgaaatttgacacattaaaaggtactccagtatttcacttttctcgatcactaaacatatgcatatatttttaaaaatcagtaaaagcattactctaagtgtagacttaataccatgtgacatttaatccagattgtaaatgctcatttatggttaatgacattgaaggtacatttattgtaccaaaccattttatgagttttctgttagcttgctttaaaaattattactgtaagaaatagttttataaaaaattatatttttattcagtaatttaattttgtaaatgccaaatgaaaaacgttttttgctgctatggtcttagcctgtagacatgctgctagtatcagaggggcagtagagcttggacagaaagaaaagaaacttggtgttaggtaattgactatgcactagtatttcagactttttaattttatatatatatacattttttttccttctgcaatacatttgaaaacttgtttgggagactctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagtgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttattttacctaaaaatg

SEQ ID NO: 374110 - DNA, 182 bp, Homo sapiens
agggagcaccacacacgaatgaggataatatccaaaatcaacttcgaattaattagactccaaagaccagcacacactgatgagagaatcagagatggaaaaccacctccacagaactgggccacagagattaccagtcataaaaagagaactgcacagaaccagaccgcagaaggcaccac

SEQ ID NO: 374111 - DNA, 360 bp, Homo sapiens
gtgaaaacacatataaaacaaaatcagcaaagggaaagacacatgggatgaagttcataaaaaaaaaaaaccacacacaagtttccaagagttctcccagtggagaacacagaggttgcacctaattcctccaataatgaattgtgacaacttgtgaaatgttgtctaaaggaaaagcttgagacttggtgcccagggttttcgttgagggctagttacataggtctaccctgccttgcacttaccaagatttcagactcccagaaggaaagtagatgttcaacataaactgcattgttagcacaaacagtttagacacaataagcccaccttgtcagggaatagtgggaaccctcttga

SEQ ID NO: 374112 - DNA, 748 bp, Homo sapiens
ggcaagggaggcaagaaagaatgttttatctgtagcattttgtgctgatagaaaaggcagggtccagtggaagaaggaggaaatggtacataatttcttcataaaaagagtaaggccagggagaagtgactgagtagacacctgtagctaaacagaggtggtgatgagtttatggtgcctccagcttctcatggccccacttgggaaattcctccagtaacattacactcactcactccttgaccatctacctttactcctctcctcatttccctgttaccaaaactatgtgccctacccagggacttctgggcagctcttttctcagatcatttctcaccctctctcctctactaacttagcctttcatactgaatcacattttccttaaaaaacagctgctgacagaagatgctacattttgtttcagggcctggtaaccatcaaggatgtgtcactgtgcttctctcaggaggagtggcggagcctggacccctctcagacagacttttatggagaatatgtcatgcaggaaaactgtgggatagtagtctctctgagtaagcatgaccttctccagccactagaagattggactctgggaggacggagccatctgcttcagggctattggatagtgtctgtctaggactctttatgtggcagggaatctgtctatgcttccgctggagaaagaacactagggccaatcccaagagaatgagagtaaatatcattaaaaaaaaaa

SEQ ID NO: 374113 - DNA, 923 bp, Homo sapiens
agcgggctggctccgccggtcgccggctcccagacgcaagcggagggcggaggggaggggcaggcggcgcccgggagggaggcaccgggccgcgggccaagcctaccgggggtcacaatttgggtctgcagcagaaatgctttcagaacagacagcagcgctggggacaagatgggaatcaatgaatgtacagctggatggagcagagccccaggtggaaaggggaagccaggaagagcggccatggagaacagtaccaggacctctggagcacctgtgctgtgaccttgaagaggagccacagtcccttcaggagaaggctcagtctgctccctgggttcctgcaattccccaggaggggaacactggagactgggagatggcagctgcacttcttgcggctggatcacagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatgggggt

SEQ ID NO: 374114 - DNA, 941 bp, Homo sapiens
ggcaagggaggcaagaaagaatgttttatctgtagcattttgtgctgatagaaaaggcagggtccagtggaagaaggaggaaatggtacataatttcttcataaaaagagtaaggccagggagaagtgactgagtagacacctgtagctaaacagaggtggtgatgagtttatggtgcctccagcttctcatggccccacttgggaaattcctccagtaacattacactcactcactccttgaccatctacctttactcctctcctcatttccctgttaccaaaactatgtgccctacccagggacttctgggcagctcttttctcagatcatttctcaccctctctcctctactaacttagcctttcatactgaatcacattttccttaaaaaacagctgctgacagaagatgctacattttgtttcagggcctggtaaccatcaaggatgtgtcactgtgcttctctcaggaggagtggcggagcctggacccctctcagacagacttttatggagaatatgtcatgcaggaaaactgtgggatagtagtctctctgagatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatgggggt

SEQ ID NO: 374115 - DNA, 442 bp, Homo sapiens
tcagaaatatagaattgctgttgaactaattgacagctctattttcctttcccatgagcaggatttccaattcccaaactggacatgctttctcaactagaaggaggagaagaacaatgggtccctgacccccaggacttagaggagagggacattctgagggtcacatatacaggagatggaagtgaacatgagggggatacccctgaactagaagcagaacctcccagaatgttatccagcgtgtctgaagatactgttctctggaacccggagcatgatgagagctgggattccatgcccagcagctccagaggaatgctcctggggcccccttttcttcaggaagatagtttctcaaacctgctgtgtagcacagagatggattccctgttaagaccccacacatgcccccagtgtgggaaacagtttgtatgggggt

SEQ ID NO: 374116 - DNA, 1302 bp, Homo sapiens
ggggtatctttgcccatccttgcttagaccagtctagaccctctggccctctgcattcccagttccaaatgctagggatggagaatgtgcttgggcttgcataagacggggctatgcccctggctctcctcagctgtagtcagtattgctagctgcccacaactcacgccagtgggtgaagatgctggtctcagagaaccagagcttggcaggccccctcatacacctcttggagaggtagatgctggtcaactatgcaccattacctgtgagcagagcttactcctctgccattctctctccaggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374117 - DNA, 1067 bp, Homo sapiens
atgggactgaaacctggcagcctgtctctgacagctttagtcaggccagcgtcaggagctggtgggaccctcctccctagggctgagtaaaccgtggagcactgagcccctgcctttcactcagagacacactgttttcttttccctcttccaggaagaggaagacagaccagttcctgagggatgcagtggaaaccagactgagaatgctgatcccatacattgagcactggccccgggtaccaagtctatatccaggccccagagcaacaataatcctaatatttatcattctcagcacctttcactcagatgactttgtacactgttcagaacttagcttctcaatctctataaacccgacaatacttagtacacttggtaaagctgggtttcaaacttggacataccaaagagagtgactgagccatctgtgtctcagttcttggaaatgtgagtggtccgggtactggatcccatcctgggtggggttctcctagtggtctgagtgtgccaccaggtctgcagggaggaggaatccatgcaggaggttagaagagtcagaagattttattggctgtcttcacttgaataacagccctgtggcattttagatctcgagcactgggatttgtcaattgtcaatgtgatgcttggggactggcatattcgttgcaaggggttttttcaccttttctgaagcttcctttttcctctgttttaaagcatatcacagtatgggccattctctgagtgaagaaagtacagagtgaaagtacacccgaagtgagagggactcagacatcttgtgtcctttgctcagctggaagactactaagcacgtagtttcagtcattcagttgatagacatttgaacacttatggtggtgcctaaccccaggccgagtgtgactcattccaccttgcagttaaagcagtggaagtgcacgtatgaggccctcaactgccttcctgattcagcatagtgttttcttctgggctgcttcactaagagaaaaccttacagccaatccgcggaggacctctctgatcacctccccagtgga

SEQ ID NO: 374118 - DNA, 253 bp, Homo sapiens
gtaagtttaacgccacctaagggcagctcctctcaccaccacccttcctcaagtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374119 - DNA, 2219 bp, Homo sapiens
  misc_feature (1663)..(1663): n is a, c, g, or t
  misc_feature (1714)..(1714): n is a, c, g, or t
  misc_feature (2218)..(2219): n is a, c, g, or t
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagttaaaaaaaaaaaaaaaaaaaaaaaaaaaaanaaaaaaaaaaaaaaaaaaaaaaaaaaaaaaagaaggggaggggggcgcgcnacaacactaaatacacccccgaaggagggcgcccccaagaatctacggctcgcacgccacgtttgtttttcgaaaaaggagggcggccccatctaaggggagggcaagcattatatacagcgcaggaggcgcgcgggccgggcatggttacaacaacacacggcgagcggggaggaaacacaccgcgcacgaaggagggacacatctttgtgagaagaaagaaacccacccccaactcggggagggggggggggaacacccaatatgtgcgccgacacacactctccctcaagaaaagatatattataacaggcctcccgggggggatatcaatctaataagtcttatggcaggcggattatagagatgggtgttgattaccaccaacccagcggcgatatatagtcgccttccgatgaaaaaaatttgtgacccaaccagcagaagttatgataatacagcgacataatattactcaccgcggcggtgtgatcaatatatcgnn

SEQ ID NO: 374120 - DNA, 1681 bp, Homo sapiens
  misc_feature (1606)..(1606): n is a, c, g, or t
  misc_feature (1636)..(1637): n is a, c, g, or t
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgccgtttttttgttttttttttgtctgtcnccctccttttttctctgaagccttttgccnntttcttgttctcttgggccttttttccttttttctttccttttt

SEQ ID NO: 374121 - DNA, 1721 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagagcaggaggccgcagaagacgctcggcggttctggcctccgagcagcaggcggcgctgtgagtcgtctttgcggaagccgcggaggcctcgctgactgacttccggtgttggcggtggcgccgcgcagtcaccgcggagcagacgcggaggctggtggcccctgggcgagatgccgtacgccaaccagc

SEQ ID NO: 374122 - DNA, 1643 bp, Homo sapiens
agccgcctggctagcttcggccctgctccgctgcctgtgaggggcagatgcagcggggcagggcctgtcacccccatttcatggagttggcagagcctcagagagggctcgggtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374123 - DNA, 3171 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgatgtgagtgctttctgcaggcccacaggaggctgggaaaggcttgtgttaagcatttcttcaagaagcttgtgaaattgctttgatcataagcccctgcaggggggctgcagtgtcattcccatctaaggtatgaggaaggtccgtcaagaagccaaagtgggatctaggtcatcttcattcagggaccagcattctagccacaaaccagttattatttcttccagcttgtggtgacaccaggtgtcagagatcctttagcattggcgaaagctaattgggctgccattttattatcatttccctctctcctaagatgtagattctgcagcaaaattcctcttttgaaaaaaagaaatgccatggaggcacccattgctttaaaaagaaattcccttccccagcccatcttggcctgctttgctaagtgatcaataaggctctttaaacagcaccaggaaagaatccgacttgttaatgctatcatatttctggtaggaaattttaaaaaatacaccttcataaaagaaaatgtgatgatactttgtggaatcctggatgaggaggcacagaaatactcccaccatagttataacaaagtgttttaataaacttcctccatgtgggaatataatgccaacagagacggtaggaaaatgaaattagaaagcaaagaaattaaaggaataaaacaccaagcagctgagctggtcctctgaagagtagtttgctagaacaatcagaagttgctgagggacttgaactctcagctttgcccaggtattgtaatctgtccatgagcctctctcagccctcactttattgatgaacacaccaaggttcggtcatagctggctgattacagcgtcttctgggactcagatgtcttaagatgtaggctttctactagcagttccaaaatggattggatgtagccaaatcatctgggatacttattaagtttcctgattcctggcactttatttagatccattgactctactcttaagaggttgggcccaggagcttgcatttttaatcaagtaggtaattctgatgctcagtcaagtttgagatggtagtgttgtccagagggccagatgtatctgtgacagtcaagaagtagtcaagagggaacccaggagttcccatggccttgggtaggaactgcctcagacttgcaccagcccacagcggtagtgtgggtttctttacagtttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaggtggggactagccattggggaaccctctttagaaggcatacctattctcctcaggtcacagctggtcttgctcccttttggcctcagctgacagtcctgagggccttcccaagggcctggctggttcttcctcaggccagcccttccctaagagccacactttgctcatttgtgattgtgttgtccaaagctctccttccagtaacgtggcccccttgtcttcaccttttggggctcataggcctcctgatttgtcctgcctgtctcaagtttaactttgtgttggtggcctaagggaacctgacactgactccttctaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374124 - DNA, 1055 bp, Homo sapiens
gggatagggggggactcctctgaaaatgatgagccagtactgtagagcatgggccggggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374125 - DNA, 1333 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacggtgagtactgcccagcacatccctgcccctcctctctcccattccggctctgtgatacatgtgttactgacttcacatcattttgtagccctaacctggaaacaataatctaataataaggctgacaatggttcagccctagtgtcttgattccaaaaaccccacttctttattttttcctgtcatcaggagatatcactgactcctgggaccctggtatatcaagtctctgtatcatagccacacctgccaccttgcaaacctggatcttggccaggtgcagtggctcatgcatatcatctcagcgatttgggaagatcgcttgagcccaggagtttgaggacagtctggccaacatagcaaaaccctgtctctatgcaaa

SEQ ID NO: 374126 - DNA, 1001 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374127 - DNA, 1464 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggtaccaagtctatatccaggccccagagcaacaataatcctaatatttatcattctcagcacctttcactcagatgactttgtacactgttcagaacttagcttctcaatctctataaacccgacaatacttagtacacttggtaaagctgggtttcaaacttggacataccaaagagagtgactgagccatctgtgtctcagttcttggaaatgtgagtggtccgggtactggatcccatcctgggtggggttctcctagtggtctgagtgtgccaccaggtctgcagggaggaggaatccatgcaggaggttagaagagtcagaagattttattggctgtcttcacttgaataacagccctgtggcattttagatctcgagcactgggatttgtcaattgtcaatgtgatgcttggggactggcatattcgttgcaaggggttttttcaccttttctgaagcttcctttttcctctgttttaaagcatatcacagtatgggccattctctgagtgaagaaagtacagagtgaaagtacacccgaagtgagagggactcagacatcttgtgtcctttgctcagctggaagactactaagcacgtagtttcagtcattcagttgatagacatttgaacacttatggtggtgcctaaccccaggccgagtgtgactcattccaccttgcagttaaagcagtggaagtgcacgtatgaggccctcaactgccttcctgattcagcatagtgttttcttctgggctgcttcactaagagaaaaccttacagccaatccgcggaggacctctctgatcacctccccagtgga

SEQ ID NO: 374128 - DNA, 1633 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374129 - DNA, 2251 bp, Homo sapiens
  misc_feature (1695)..(1695): n is a, c, g, or t
  misc_feature (1746)..(1746): n is a, c, g, or t
  misc_feature (2250)..(2251): n is a, c, g, or t
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagttaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaagaaggggaggggggcgcgcnacaacactaaatacacccccgaaggagggcgcccccaagaatctacggctcgcacgccacgtttgtttttcgaaaaaggagggcggccccatctaaggggagggcaagcattatatacagcgcaggaggcgcgcgggccgggcatggttacaacaacacacggcgagcggggaggaaacacaccgcgcacgaaggagggacacatctttgtgagaagaaagaaacccacccccaactcggggagggggggggggaacacccaatatgtgcgccgacacacactctccctcaagaaaagatatattataacaggcctcccgggggggatatcaatctaataagtcttatggcaggcggattatagagatgggtgttgattaccaccaacccagcggcgatatatagtcgccttccgatgaaaaaaatttgtgacccaaccagcagaagttatgataatacagcgacataatattactcaccgcggcggtgtgatcaatatatcgnn

SEQ ID NO: 374130 - DNA, 1623 bp, Homo sapiens
aattaggctaggtacgaggctgggtgttagcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374131 - DNA, 1579 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgacacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374132 - DNA, 2847 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgatgtgagtgctttctgcaggcccacaggaggctgggaaaggcttgtgttaagcatttcttcaagaagcttgtgaaattgctttgatcataagcccctgcaggggggctgcagtgtcattcccatctaaggtatgaggaaggtccgtcaagaagccaaagtgggatctaggtcatcttcattcagggaccagcattctagccacaaaccagttattatttcttccagcttgtggtgacaccaggtgtcagagatcctttagcattggcgaaagctaattgggctgccattttattatcatttccctctctcctaagatgtagattctgcagcaaaattcctcttttgaaaaaaagaaatgccatggaggcacccattgctttaaaaagaaattcccttccccagcccatcttggcctgctttgctaagtgatcaataaggctctttaaacagcaccaggaaagaatccgacttgttaatgctatcatatttctggtaggaaattttaaaaaatacaccttcataaaagaaaatgtgatgatactttgtggaatcctggatgaggaggcacagaaatactcccaccatagttataacaaagtgttttaataaacttcctccatgtgggaatataatgccaacagagacggtaggaaaatgaaattagaaagcaaagaaattaaaggaataaaacaccaagcagctgagctggtcctctgaagagtagtttgctagaacaatcagaagttgctgagggacttgaactctcagctttgcccaggtattgtaatctgtccatgagcctctctcagccctcactttattgatgaacacaccaaggttcggtcatagctggctgattacagcgtcttctgggactcagatgtcttaagatgtaggctttctactagcagttccaaaatggattggatgtagccaaatcatctgggatacttattaagtttcctgattcctggcactttatttagatccattgactctactcttaagaggttgggcccaggagcttgcatttttaatcaagtaggtaattctgatgctcagtcaagtttgagatggtagtgttgtccagagggccagatgtatctgtgacagtcaagaagtagtcaagagggaacccaggagttcccatggccttgggtaggaactgcctcagacttgcaccagcccacagcggtagtgtgggtttctttacagtttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374133 - DNA, 1740 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggaagtccacgggagaggcactggtgcaaggactgatgggtgcagcggtcacgctcaagaacctgacgggtctaaaccagcgtcggtgagagaagggaacccgtgtgctgggaggagcagcagtagatatgaagggctttgacaagatgtgccacccattgaacaggatgttaatgagaacacactgaagaacttggagtcgtatgacagccacaaggctggaaatcacaatgcacttgctgccgttctgacctggaactgggccacttcttcagttcctaatgccaggcctggcctcctgatgccttttgcattgcagctgtgtgtttgaaaactgaggctcacatccaaggtttcaaaccacaaaaccttggcatgactctgccatggtgtcacaggcatcttgatcatgtcttgaccatagaattgctctctaggagctgggcatggtgacctacgtctgtattctcagcactcaggagactgctacagcaagattgagagatcagaggcaggcttgtctttgtagagaattacaagcctgcttgagctacagagtgtgatcctgtcaaaatcccctgagaaatattcttaggggctcacaaccaaggtccggaggcaacacatagtgggagctcttccccagcacagggcagacagtgctcacaaacatttgccactggccattgcctctggaccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374134 - DNA, 1657 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggcgattgcagaaggagcccagtctctgggtctctccagtgcagcagccagcatgttcgggaaggatggcagtgagctaatactgcattttgtgacccagtgcaatacccggctcacacgtgtgctagaagaggagcagaagctggtacagttgggccaggcggagaagaggaagacagaccagttcctgagggatgcagtggaaaccagactgagaatgctgatcccatacattgagcactggccccgggccctcagcatcctcatgctccctcacaacatcccgtccagcctgagcctgctcaccagcatggtggatgacatgtggcattacgctggggaccagtccactgattttaactggtacacccgccgagccatgctggctgccatctacaacacaacagagctggtgatgatgcaggactcctctccagactttgaggacacttggcgcttcctggaaaaccgggttaatgatgcaatgaacatgggccacactgccaagcaggtaggtggggactagccattggggaaccctctttagaaggcatacctattctcctcaggtcacagctggtcttgctcccttttggcctcagctgacagtcctgagggccttcccaagggcctggctggttcttcctcaggccagcccttccctaagagccacactttgctcatttgtgattgtgttgtccaaagctctccttccagtaacgtggcccccttgtcttcaccttttggggctcataggcctcctgatttgtcctgcctgtctcaagtttaactttgtgttggtggcctaagggaacctgacactgactccttctaggtaaagtccacaggagaggcactggtgcaaggactcatgggtgcagcagtgacggtgagtactgcccagcacatccctgcccctcctctctcccattccggctctgtgatacatgtgttactgacttcacatcattttgtagccctaacctggaaacaataatctaataataaggctgacaatggttcagccctagtgtcttgattccaaaaaccccacttctttattttttcctgtcatcaggagatatcactgactcctgggaccctggtatatcaagtctctgtatcatagccacacctgccaccttgcaaacctggatcttggccaggtgcagtggctcatgcatatcatctcagcgatttgggaagatcgcttgagcccaggagtttgaggacagtctggccaacatagcaaaaccctgtctctatgcaaa

SEQ ID NO: 374135 - DNA, 966 bp, Homo sapiens
gtccttcgacttccccggccacaactacacacgagaaacatcctgccaggtttaaacatcacttgtacccttccacaagactcagaatccacagtgtcccattttccgactaggagacatcttccgagaaacaggcgataatttttcagatgtggcaattcagggcggaataatgggcattgagatctactgggactgcaacctagaacatgggccacactgccaagcaggtaaagtccacaggagaggcactggtgcaaggactcatgggtgcagcagtgacgctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgctcctgggagccccctcagaaaactgcctcacctgagacaagtgcctgctggacagaggtgtgattccaggcctggtgtcacatgacaccagcatgcattgcaggattattagtgtattttgagtctgtaaaaataataaatatgtttgaagtagtt

SEQ ID NO: 374136 - DNA, 486 bp, Homo sapiens
gtcgccgtgggcgacgtgcccgcttccaaaatggcggcggcggcggtatctggtgcgcttggccgggcgggctggaggctcctgcagctgcgatgcctgcccgtggcccgttgccgacaagccctggtgccgcgtgccttccatgcttcagctgtggggctaaggtcttcagatgagcagaagcagcagcctcccaactcattttctcagcagcattctgagacacagggggcagaaaaacctgatccagagtcttctcattcaccccccaggtatacagaccagggcggcgaggaggaggaggactatgaaagtgaggagcagttgcagcaccgcatcctgacggcagcccttgagtttgtgcccgcccacgggtggacagcagaggtgtgattccaggcctggtgtcacatgacaccagcatgcattgcaggattattagtgtattttgagtctgtaaaaataataaatatgtttgaagtagtt

SEQ ID NO: 374137 - DNA, 430 bp, Homo sapiens
tgaggtctgaggagctgcagtgatagcttagaaattatgcaggggatttctgattcttaagaccttttggcatcatcttctggagggaggaagcgtcaaggctatagtatccatgctgttgggggtgtgggggtggagggtgcagtgcaaattatgggtacatggaggtgtacaggaggatacttgagatttgggagctggggcatagaagagggtagcattgcacagcttttgttttgccttctttgtaaacacctggctcctcttctggcatactttttggaagtttgtacagcattatccatcggccagtgctgcagaggccagtcttagaggacagcccagtaggcctttaccatgctttgcctctgctaaccagatgattttccttatgcttaaggggtgactgaaataatatgttgtgttattt

SEQ ID NO: 374138 - DNA, 828 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagtgagtctacttccatttttttaaagaattttagtgtattgtttgagat

SEQ ID NO: 374139 - DNA, 1005 bp, Homo sapiens
  misc_feature (786)..(787): n is a, c, g, or t
  misc_feature (794)..(794): n is a, c, g, or t
  misc_feature (796)..(796): n is a, c, g, or t
  misc_feature (801)..(801): n is a, c, g, or t
  misc_feature (807)..(807): n is a, c, g, or t
  misc_feature (809)..(810): n is a, c, g, or t
  misc_feature (815)..(815): n is a, c, g, or t
  misc_feature (824)..(824): n is a, c, g, or t
  misc_feature (826)..(826): n is a, c, g, or t
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaacagactgatacagtctatatcgtgtnnaacgaangngcccnccaggngnnttccngcccgttgnanggtgcgagcaagagagctcttgtatgaaaaatcgtgcggtgggatgttcccgaacttgggaggaccttagggcacaaaacgggggtcagaaacccaggacggattgacacacgggaagcacagggatctcacaggggatttgcgacgtcacccaaagcggcaattacgttcggtcacgg

SEQ ID NO: 374140 - DNA, 785 bp, Homo sapiens
  misc_feature (612)..(612): n is a, c, g, or t
  misc_feature (618)..(618): n is a, c, g, or t
  misc_feature (624)..(624): n is a, c, g, or t
  misc_feature (649)..(649): n is a, c, g, or t
  misc_feature (652)..(652): n is a, c, g, or t
  misc_feature (691)..(691): n is a, c, g, or t
  misc_feature (694)..(694): n is a, c, g, or t
  misc_feature (697)..(697): n is a, c, g, or t
  misc_feature (704)..(704): n is a, c, g, or t
  misc_feature (716)..(716): n is a, c, g, or t
  misc_feature (719)..(720): n is a, c, g, or t
  misc_feature (736)..(736): n is a, c, g, or t
  misc_feature (747)..(747): n is a, c, g, or t
  misc_feature (756)..(756): n is a, c, g, or t
  misc_feature (774)..(774): n is a, c, g, or t
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggcatttgaacctttgggaaagaatccaaatngggagngttacncccaggatttggaacaattccttgnaanccatccctttgggaagggagttccaaaaaaagcccaagnccnggnaacagtncctaaaaattgnggnnaaaaaaaaagtggggnaaccccaaggngggggttanccctggccccccggtttnaaaaggggtcc

SEQ ID NO: 374141 - DNA, 843 bp, Homo sapiens
ttgagaccagcctggccaacatggtgaaactctgtctctactaaaaatacaaaaattagccgggcatggtggcatgtgcctgtaatcccagctactcgggaggctgaggcagacagaattgtttgaacctgggaggcggaggttgcagtgaaccgagatgcgccactgcactccagcctgggcaacagagcaggactgtctcaaaaaaaaaaaaaaaaaaaaaatcatgggaaatccctgtgcctaaaaatagcccctaactattttgatgacctctttcgtgcaccaagtgtgtgcatgcttgatacgtgtgtgttgttttcattaagatgaatttgtgcgtgccgttttgattgtaaatatctttgggtactctgtcttccttcttatccctctacttcctgccagtgttaacaacctgaatgatagtatcttccggtgctttcgtttccccattgttgtatatgttttctttttaaaggaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggtttta

SEQ ID NO: 374142 - DNA, 3153 bp, Homo sapiens
  misc_feature (2824)..(2824): n is a, c, g, or t
  misc_feature (2841)..(2841): n is a, c, g, or t
  misc_feature (2846)..(2846): n is a, c, g, or t
  misc_feature (2849)..(2850): n is a, c, g, or t
  misc_feature (2853)..(2853): n is a, c, g, or t
  misc_feature (2860)..(2860): n is a, c, g, or t
  misc_feature (2863)..(2863): n is a, c, g, or t
  misc_feature (2897)..(2897): n is a, c, g, or t
  misc_feature (2904)..(2904): n is a, c, g, or t
  misc_feature (2909)..(2910): n is a, c, g, or t
  misc_feature (2924)..(2924): n is a, c, g, or t
  misc_feature (2935)..(2935): n is a, c, g, or t
  misc_feature (2943)..(2943): n is a, c, g, or t
  misc_feature (2958)..(2958): n is a, c, g, or t
  misc_feature (2966)..(2966): n is a, c, g, or t
  misc_feature (2994)..(2994): n is a, c, g, or t
  misc_feature (3019)..(3019): n is a, c, g, or t
  misc_feature (3022)..(3023): n is a, c, g, or t
  misc_feature (3039)..(3039): n is a, c, g, or t
  misc_feature (3064)..(3064): n is a, c, g, or t
  misc_feature (3070)..(3070): n is a, c, g, or t
  misc_feature (3075)..(3076): n is a, c, g, or t
  misc_feature (3082)..(3083): n is a, c, g, or t
  misc_feature (3103)..(3103): n is a, c, g, or t
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttgaaaaagaagtataaaaacaactgtattgagttgaggctgtggagaaataaggacacatatatgggaatggaatgcaaaagttaaactttggttaacaagaatatttgggcaggtgcagtggctcacacctgtaatcccaacaccttgggaggccaaggtgggcggatcacttgaggtcaggagttcaagaccatctggccaacatggtgaaaccctgtctctactgaaaataaaaaaaactagctgcgcgcnatgcgctgcgcaagcangcaangcnnaanaaagcanaanagcgcgcagcaatgcacgcgcgaaagccctaaanctgcaanaatgnngcaagcaagcaggngcaagcagcantaaaatgncaaaaaagccgcagncaagcagncttgcaagctgcagcatgcagcgtgtgntgcaaaaatgcaaagtaaaagcaantgnngctgcaaaagcagctnaagcaagtatgtgctagtaagcagnagcagntagtnntgcgcnnaagtaaaaaaagtaaagcangtgcaaaagtagtgtaagtgtgtagtaaatgtgtgcaaaaaaagcaaagt

SEQ ID NO: 374143 - DNA, 1949 bp, Homo sapiens
  misc_feature (1759)..(1759): n is a, c, g, or t
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattaaaaaaaacaagataattaaaaatacacagaaaacaaaaaaaagaggggggggtctaatatctccggggggccaattaacgtgacacattttttggaagggncccagagggggtataaaagaagagggggggtcaaatgcgggggaactgctctggtcttgggaaccctccttgggttaggaccccagataagcccgggaaagatatggtggacgttctgcgttgtcgtgatatatttaattatgataatttctgagatcaatattaattggtatagttggtatatatagag

SEQ ID NO: 374144 - DNA, 1526 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatttagttttgccgtggatcagatggtttataaaagtaataaccataaagcaaaaaataatttgaaagcccgtctattcctatgctcaataaagttaagtttttcttcatta

SEQ ID NO: 374145 - DNA, 1389 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttaaaaaaaaaaaaaaaaaaaaaaaaaaaaaaaaaaaaaaaacaaaaaaaaaaaaaaaaaaaaaaaaaaaaacatgtcgcccgcttgggcccagccgattttagacttgggcaagttaatccatgtggccgaatttcgggctaattgggccaattcgccttatagggggtcgattaacaatcaattggccgtggtttaaaaacttgggaatgggaaaaaccttgggtttcccatttccgcttgggtcccct

SEQ ID NO: 374146 - DNA, 1607 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374147 - DNA, 1737 bp, Homo sapiens
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374148 - DNA, 1609 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374149 - DNA, 1622 bp, Homo sapiens
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtctgcgctcggtttgagggctcggcgcggggtttcctgttccttcttctgcgcggctgcagctcgggacttcggcctgacccagcccccatggcttcagaagaggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374150 - DNA, 1360 bp, Homo sapiens
ttgagaccagcctggccaacatggtgaaactctgtctctactaaaaatacaaaaattagccgggcatggtggcatgtgcctgtaatcccagctactcgggaggctgaggcagacagaattgtttgaacctgggaggcggaggttgcagtgaaccgagatgcgccactgcactccagcctgggcaacagagcaggactgtctcaaaaaaaaaaaaaaaaaaaaaatcatgggaaatccctgtgcctaaaaatagcccctaactattttgatgacctctttcgtgcaccaagtgtgtgcatgcttgatacgtgtgtgttgttttcattaagatgaatttgtgcgtgccgttttgattgtaaatatctttgggtactctgtcttccttcttatccctctacttcctgccagtgttaacaacctgaatgatagtatcttccggtgctttcgtttccccattgttgtatatgttttctttttaaaggaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374151 - DNA, 1105 bp, Homo sapiens
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtctgcgctcggtttgagggctcggcgcggggtttcctgttccttcttctgcgcggctgcagctcgggacttcggcctgacccagcccccatggcttcagaagaggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggtttta

SEQ ID NO: 374152 - DNA, 845 bp, Homo sapiens
  misc_feature (816)..(816): n is a, c, g, or t
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaattagattcattaccttaactggagttcatcagttcccctgagaatgtgcaggtgcatttcacagagaggtcatttgatcttttggtaaagaatctaaatgggaagagttactccatgattgtgaacatctcttgnactgccttccacagagatgggtttcaagc

SEQ ID NO: 374153 - DNA, 1658 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374154 - DNA, 794 bp, Homo sapiens
  misc_feature (765)..(765): n is a, c, g, or t
ggtggagccaggcttggcgggctgtgcgtgctcgcggtgggcggtggcggcggctgcctcgcgaaggttcgagatccgtcgcgtgcgggaggcgggccgcgatcttgcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaattagattcattaccttaactggagttcatcagttcccctgagaatgtgcaggtgcatttcacagagaggtcatttgatcttttggtaaagaatctaaatgggaagagttactccatgattgtgaacatctcttgnactgccttccacagagatgggtttcaagc

SEQ ID NO: 374155 - DNA, 1016 bp, Homo sapiens
  misc_feature (1002)..(1002): n is a, c, g, or t
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagacctctatgacactgaaccgatctagtggggattgatgatgtctaaagttatggatggnaccatgtttgagcg

SEQ ID NO: 374156 - DNA, 1141 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggtttta

SEQ ID NO: 374157 - DNA, 1842 bp, Homo sapiens
tgggcttccgctacagggcccggtcacgaggccaacgtagctccacctctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374158 - DNA, 1603 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaattaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374159 - DNA, 1642 bp, Homo sapiens
ggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374160 - DNA, 1723 bp, Homo sapiens
  misc_feature (209)..(209): n is a, c, g, or t
  misc_feature (211)..(211): n is a, c, g, or t
gctagtagcatcaggctggcgcgcgtgtcgcagtgatctaagtgaacagtgtgtcagtaggttgccctctacggaaggtcctgagatcctgactacgtgcgttgaattcgtcacgaaattacatatgcacgcgcacgcggtgcggtgtcgggcaagcgttgctgaacgaaggcatcgcaaatcggtagttgcgtgtgaaggtcgtcttngntgcgtgcaatcgttatcgaagcgagctgccagtccgcggcggagccctatatctccttcatgccccggtcgtgagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374161 - DNA, 1690 bp, Homo sapiens
cccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374162 - DNA, 1100 bp, Homo sapiens
ccgatgaatagcgaagtgccgatgaatagcgaggtgccgatgaatagtcgctattcatcggcaccctccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcatta

SEQ ID NO: 374163 - DNA, 775 bp, Homo sapiens
ggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttccttcttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaaaggcgttttccaattcagaatgatacagttctactatcgtgtagaaacaaacatgcaaacacatcggatctggttgacgatgacccagcactga

SEQ ID NO: 374164 - DNA, 1326 bp, Homo sapiens
tcatgtaatcccacctactcgggaggctgaggcacaagaatcacttgaacccagcaggtggaggttgcagtgagccaagactgctcctctgcactccagcctgggcaacagagtaagactgtctcaaacaaaacaaaacaaaaaacagtatcttaacctgtacattatgtttctttatctagatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattcagtgtatgtcattattactgctaaggaaatcttagcccttgtctgccttaaaggaatctttatttaatttactgtaattattgctgtgtagtcactacttttgttaatttctcaaatcacttagatgatggtcttgttttccacttagtaggtatacagagctttgacgttcctattatttcctatataagagaaatttaaaacattttttgttctttctgtcttaggggaataaaaaaacactaaccacacatttggttaaactgcttaggagaagacataataaagattccccaatctatacttaacagccataaacctgagttacaggctcagttactccaaataaatagttcttataggtacttaattaattaggccttggtatctaaataacaaaataatgtccccaaataaataagaggaaggcagccctatacctttgttgctctatggtgacaacataaggacctggcaaatcactcatgttttaaagctgtaactatgtcaagcatttattaagatttagtagagaacgt

SEQ ID NO: 374165 - DNA, 904 bp, Homo sapiens
atacaaatagggcatgtgacagtttttttaatctcaaagagggaatgtactttcaggtaagacctttgtaagatgacagatacctccagggtcttcaagccttttttttttttttaggaatcaggtcacaatgtgaaaagtccttggaattccatgagaaaacacaactttatttcagaaataagctttgaactttgaaaacaagagcaggtacactgttttccagaactagtttctggaaccagatcacagtgttgtcttttttaaaaaataggtagtaagtggttaagagacaattgaatagtacgtgacaggagtgactatttctttctaactggagtcagccctccatatccttgggatccacatccaaggattcaaccaacctcagatgggaaatattcaaaagaacaaacaaacaatttaaaaaaaagaaaaacaatagaacaattaaaaataataccaatttaaaaatacagtataacaactatctacatggcatttacatttattgggtattataagtgatctagagtaatctaaagtgtatggggaaatgtgcataggctatatataaatactatgctattttacagggacttgagcatccttctgtggattttggtatccaagggtttcaggaaccaatcccccatggataccaagagatgactagactcatatcaaaatatcttctgacttcaaatttatctaaaaaaagacatttttgtttgatattttcttgggtttagaggaactttaaactgagctattctgctggtcttattaatagaaggatggtgccatctttctaagatattcatgctctatgaatacaacatcagaaagtaagtgataacaaatggaggttataggagggtaattagtgtagagggaaaaatgt

SEQ ID NO: 374166 - DNA, 6335 bp, Homo sapiens
ccggaattccggggtcgactactactactaaattcgcggccgcgtcgactgaagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374167 - DNA, 7553 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374168 - DNA, 7430 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtaggtacagcaccttttatctggcctgctttgtttagagaaggtgtgacgaggtctaaggcattgaattgtgagtgtttggggagaaaatggttatcttcttggttttatccttttcctgcagagtgtgtgttctttgtctcactttcttgggcactttaattgggttctgaaatggccctgagccacactattcaaacagaaatgctcaggttttgactttttctcttcaccatattttgttgtttatatttcttacagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374169 - DNA, 7625 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtaaagaggattaggctgccttcagccaaatctgtcactgaagctatgcaaacggcccagccttctgagaaggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374170 - DNA, 7445 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374171 - DNA, 7760 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggtaacccaaaggcttttttcagactggccttgggacttgctgtctgcagtaaaattattttcttttgtccttgggctctttccaggtgaagcgggagggcatcataggccaaccaggaacagaaggggtgaataccgttgtgagggttcacacaggaggtgacaactaggtctttctctactgtgcctctccacccttgttcctcaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374172 - DNA, 8172 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctggggtgagtgaggtcacagccacactaccagaacagtgctgctagctaggtaaaattccttttttttttttttttttgagacagagtctcgctctgtccccaggctggagtgcagtggcacgatctcagctccctgcaacctccgcctcccaggttcaagtgattctcccgcctcagcctcccaagtagtgacagagtgtgactccatctcaaaaaaagaatgttgaggtgggtatgtcgctcagcaggacccccacttgggcagacagatggaatggagactttgaaggcatgtgcaatttaggattgtactcttggatctatagcctatatatccagggtatcatccaccaggaaccaacatgcacgttgataccatgtaagccttccttgatgttttggagaaatgaggcattagaaggggcactgaatcctactgcggagtgaagttacaataagcgtatgcatttctggcccaataacctttatctgagtgaggtgttcctgcctgcctgtgaacatggctgggatgtttctattctagccacgatcacaatgagtgggatgagaacagtgagctttgggagtcagactcggcaaatcttctttatttcccctacagaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374173 - DNA, 8091 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattcagtgtatgtcattattactgctaaggaaatcttagcccttgtctgccttaaaggaatctttatttaatttactgtaattattgctgtgtagtcactacttttgttaatttctcaaatcacttagatgatggtcttgttttccacttagtaggtatacagagctttgacgttcctattatttcctatataagagaaatttaaaacattttttgttctttctgtcttaggggaataaaaaaacactaaccacacatttggttaaactgcttaggagaagacataataaagattccccaatctatacttaacagccataaacctgagttacaggctcagttactccaaataaatagttcttataggtacttaattaattaggccttggtatctaaataacaaaataatgtccccaaataaataagaggaaggcagccctatacctttgttgctctatggtgacaacataaggacctggcaaatcactcatgttttaaagctgtaactatgtcaagcatttattaagatttagtagagaacgt

SEQ ID NO: 374174 - DNA, 8188 bp, Homo sapiens
  misc_feature (6358)..(6358): n is a, c, g, or t
  misc_feature (6363)..(6364): n is a, c, g, or t
  misc_feature (6426)..(6426): n is a, c, g, or t
  misc_feature (6428)..(6428): n is a, c, g, or t
  misc_feature (6497)..(6498): n is a, c, g, or t
  misc_feature (6504)..(6504): n is a, c, g, or t
  misc_feature (6611)..(6611): n is a, c, g, or t
  misc_feature (6623)..(6623): n is a, c, g, or t
  misc_feature (6652)..(6652): n is a, c, g, or t
  misc_feature (6691)..(6691): n is a, c, g, or t
  misc_feature (6711)..(6711): n is a, c, g, or t
  misc_feature (6755)..(6755): n is a, c, g, or t
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctggggtgagtgaggtcacagccacactaccagaacagtgctgctagctaggtaaaattccttttttttttttttttttgagacagagtctcgctctgtccccaggctggagtgcagtggcacgatctcagctccctgcaacctccgcctcccaggttcaagtgattctcccgcctcagcctcccaagtagcngggannacaagcacctgccaccacacccggctaattttttgtatttttaatagagatggggtttgacnangttggccaggctggtcttgaactcctgacctggtgaactgcccacgttggcctcccaaagtgctgggannacaggngtgagccaccatgcccggccctcgataaaattcttacagcaaaggacaagagcccatgagatgggctattagaatcttgaggtaggtggcccggcacagtggctcangcctgtaatccnagcactttgggaggccaaggtaggtggantgcctgagctcaggagttcaacaccagcctgggcaacanggtgcaatcctgtctctacnaaaatacaaaaaaaaaatagccaggtgtggcggcatgcacctgnaatcccaactacttgggaggctgaagcaggtggatcacttgaacccgggaggcggaggttgcagtgagccaagatcgcgcccattgcactccagcgtaggtgacagagtgtgactccatctcaaaaaaagaatgttgaggtgggtatgtcgctcagcaggacccccacttgggcagacagatggaatggagactttgaaggcatgtgcaatttaggattgtactcttggatctatagcctatatatccagggtatcatccaccaggaaccaacatgcacgttgataccatgtaagccttccttgatgttttggagaaatgaggcattagaaggggcactgaatcctactgcggagtgaagttacaataagcgtatgcatttctggcccaataacctttatctgagtgaggtgttcctgcctgcctgtgaacatggctgggatgtttctattctagccacgatcacaatgagtgggatgagaacagtgagctttgggagtcagactcggcaaatcttctttatttcccctacagaggacagcctcaaggatgggcaccagctgaaacaactgctgctgaaggccctgactctgatgttggatgcagcagagagttatgccaaggtaacccaaaggcttttttcagactggccttgggacttgctgtctgcagtaaaattattttcttttgtccttgggctctttccaggtgaagcgggagggcatcataggccaaccaggaacagaaggggtgaataccgttgtgagggttcacacaggaggtgacaactaggtctttctctactgtgcctctccacccttgttcctcaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggtgagcaagaaagcaaactgtagccagcactgctagcatcctctctccttctgtcccactcatggaacccagaggtaaggtctcagggctagtgacagaaccaggacagtacagttctgatttaactctctgataccaacatagaacggcaatttgatgtatttctctctagtatattgttgggcagaggttagggaatggtaagacagtgctgtctccctttcctgtgctgttaggccagcagagaggcagacacctttggccctttaaccccaggctgcagactggtactggcccatggcctgctaggaaccaggccgcacagcaagtgagcactgggcaagcaagcattactgcctgcacaccatctcctgtcagatcagtgacaggactatatttttataggagcatgaaccctgttgtgaactgcacatgcaagggcttctta

SEQ ID NO: 374175 - DNA, 6869 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctggagggccccttctggcactttctatgggaggattctcgtaacagcagcacaccaactgaaaagccccaactgctcgctcttggtgaaaattatgaactgctatctatgaatttaatttgaaagatggaagatgtgatgcaccattttgtatagctgtttaatgggtgcagggt

SEQ ID NO: 374176 - DNA, 5811 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatac

SEQ ID NO: 374177 - DNA, 5568 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcagtaagtgaaggagatcagatggcccagagtcttaaatggcactgttagcactgtctccaagaaggaagggacccttgtggcagaatagttctaccaagttaaggggacaacaacttttttccaggtaatctgtagactagccaattaactaggcaatgaaatagaaagatctatgtcttttaaactagctatgtttcaaagttaaagggaatctatctgatttgtagctagttcactgaaatttattctacatattctatacatctgtaaatttaatcatttccag

SEQ ID NO: 374178 - DNA, 4104 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggaggaatcaggtcacaatgtgaaaagtccttggaattccatgagaaaacacaactttatttcagaaataagctttgaactttgaaaacaagagcaggtacactgttttccagaactagtttctggaaccagatcacagtgttgtcttttttaaaaaataggtagtaagtggttaagagacaattgaatagtacgtgacaggagtgactatttctttctaactggagtcagccctccatatccttgggatccacatccaaggattcaaccaacctcagatgggaaatattcaaaagaacaaacaaacaatttaaaaaaaagaaaaacaatagaacaattaaaaataataccaatttaaaaatacagtataacaactatctacatggcatttacatttattgggtattataagtgatctagagtaatctaaagtgtatggggaaatgtgcataggctatatataaatactatgctattttacagggacttgagcatccttctgtggattttggtatccaagggtttcaggaaccaatcccccatggataccaagagatgactagactcatatcaaaatatcttctgacttcaaatttatctaaaaaaagacatttttgtttgatattttcttgggtttagaggaactttaaactgagctattctgctggtcttattaatagaaggatggtgccatctttctaagatattcatgctctatgaatacaacatcagaaagtaagtgataacaaatggaggttataggagggtaattagtgtagagggaaaaatgt

SEQ ID NO: 374179 - DNA, 2924 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggtattataactgttgaactaatacccaatgggaagaatacaagggaagagcaagaaaaaataatggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaagtgagtactgagaatgcatttgtc

SEQ ID NO: 374180 - DNA, 524 bp, Homo sapiens
ccggaattccggggtcgactactactactaaattcgcggccgcgtcgactgaagacccagggcatgcagtgtttttcccttggcacaaagtgtattccttgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatac

SEQ ID NO: 374181 - DNA, 434 bp, Homo sapiens
ccaaaattaaaaaaaaaaaaatttatatcactgtttttaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaaggcaagtgtgagagagcctgaaatatgaacatactgaatgaggattaaattgggtattgatatttgaatattttgatgtgtctcaattttagaattcctttcgggaaataatattcaggttctttaaaatgcaagtcgttgcattaagatctctttcttatctcagagtttctgggagggatttataatgtgctaataaaagaaaaaaatagttaattg

SEQ ID NO: 374182 - DNA, 119 bp, Homo sapiens
cattattcacagccaactccacaactaccacccagcagaggtaagccactaattgttagcagtcactcaaaaggaaataggaacacttcttagaagatagcattctttctgttgtgtag

SEQ ID NO: 374183 - DNA, 507 bp, Homo sapiens
aatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctgtatccttggtggtagaagtgttgattgatacgtagaggagaagaacacctataaagatgagcctttttaggctttagttttgggagctgggatataggaagtgtggttagtttttcagtaaaacttttcatggaaaaagatcctcataaacttaaaatactaaattgtatattgctttatattttagttgaatattttccagtatatacatttttaatagtattaaccatacatatctgtgttcttttaaaattgtatattctctgcattacctgtttattcaaaatgtatttcttgaatatc

SEQ ID NO: 374184 - DNA, 717 bp, Homo sapiens
aaggacaagaaaaggaaagggttatattaaaatacagagctacttacttgtaaaaaggaaaatcctcagacatattgtttgaaatttaaaaataccaagtttgaattttgactttctttagaattctttataacagctcatggtttatatttacacacacacacacaaattggcacattggtattttccatagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggtaagtacgaataatcatcacttcttttatttgccagattcagaaggtctgagaaaacaatagaaagaaacagaattcagactctatatacttgtgattcagaatgtttggcaaaggttttaggttttatcggtttggggatttctgattatgacttcaaatttatgtctacaagctccatttatttaattcgctataagggtaggctccctcttaatgctagatctgcccacttgggttcagtaacaaacacccaactctaaacccatgtgaagtggtactccttagcaatactccctcattggctcaagcctggtgctttggacacatgcattctgcctgactgga

SEQ ID NO: 374185 - DNA, 847 bp, Homo sapiens
ggggcaaaaggtaagggagaggaggccacaaatcacatggctggcactccctctgtcactgatttaattccatttgcttttcctggtgagacataattttcatgtgctgatgtgattttgattcctttctttttcaggatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtaggtacagcaccttttatctggcctgctttgtttagagaaggtgtgacgaggtctaaggcattgaattgtgagtgtttggggagaaaatggttatcttcttggttttatccttttcctgcagagtgtgtgttctttgtctcactttcttgggcactttaattgggttctgaaatggccctgagccacactattcaaacagaaatgctcaggttttgactttttctcttcaccatattttgttgtttatatttcttacagccgaaaaactatctaaactagctgatggtgaaaagacaaccacagaagaattgcttgttctcttagaagaaggtacatggaacagcattcagcaacaggaaataaagaggtttgtgagttgcagtctcagcctcttttctaacaagcttattgtgccaacctgtgtttgcctagtttttctttgaacaactctggtgttttcactaaatccccctagaccttatcttcttctttatctagcatgtag

SEQ ID NO: 374186 - DNA, 279 bp, Homo sapiens
ggtgcctaagcctgggcagagtgggcctctcttagataaaaccagcacctgtcttcacacctctctgtacaggacataagcagatgttcaacccaacagaggaaagccagacatttcttcagctgaccactctgtgtcaagaccgcacattggtaggcatgaagttgttggataagatttcctccgttccccatggggaactgtcttgcagtaagttattgacctttttcttacatattttggccctaaacaggtctcaaaaggtctcccagtctctcc

SEQ ID NO: 374187 - DNA, 7066 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374188 - DNA, 7446 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374189 - DNA, 8498 bp, Homo sapiens
  misc_feature (6358)..(6358): n is a, c, g, or t
  misc_feature (6363)..(6364): n is a, c, g, or t
  misc_feature (6426)..(6426): n is a, c, g, or t
  misc_feature (6428)..(6428): n is a, c, g, or t
  misc_feature (6497)..(6498): n is a, c, g, or t
  misc_feature (6504)..(6504): n is a, c, g, or t
  misc_feature (6611)..(6611): n is a, c, g, or t
  misc_feature (6623)..(6623): n is a, c, g, or t
  misc_feature (6652)..(6652): n is a, c, g, or t
  misc_feature (6691)..(6691): n is a, c, g, or t
  misc_feature (6711)..(6711): n is a, c, g, or t
  misc_feature (6755)..(6755): n is a, c, g, or t
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctggggtgagtgaggtcacagccacactaccagaacagtgctgctagctaggtaaaattccttttttttttttttttttgagacagagtctcgctctgtccccaggctggagtgcagtggcacgatctcagctccctgcaacctccgcctcccaggttcaagtgattctcccgcctcagcctcccaagtagcngggannacaagcacctgccaccacacccggctaattttttgtatttttaatagagatggggtttgacnangttggccaggctggtcttgaactcctgacctggtgaactgcccacgttggcctcccaaagtgctgggannacaggngtgagccaccatgcccggccctcgataaaattcttacagcaaaggacaagagcccatgagatgggctattagaatcttgaggtaggtggcccggcacagtggctcangcctgtaatccnagcactttgggaggccaaggtaggtggantgcctgagctcaggagttcaacaccagcctgggcaacanggtgcaatcctgtctctacnaaaatacaaaaaaaaaatagccaggtgtggcggcatgcacctgnaatcccaactacttgggaggctgaagcaggtggatcacttgaacccgggaggcggaggttgcagtgagccaagatcgcgcccattgcactccagcgtaggtgacagagtgtgactccatctcaaaaaaagaatgttgaggtgggtatgtcgctcagcaggacccccacttgggcagacagatggaatggagactttgaaggcatgtgcaatttaggattgtactcttggatctatagcctatatatccagggtatcatccaccaggaaccaacatgcacgttgataccatgtaagccttccttgatgttttggagaaatgaggcattagaaggggcactgaatcctactgcggagtgaagttacaataagcgtatgcatttctggcccaataacctttatctgagtgaggtgttcctgcctgcctgtgaacatggctgggatgtttctattctagccacgatcacaatgagtgggatgagaacagtgagctttgggagtcagactcggcaaatcttctttatttcccctacagaggacagcctcaaggatgggcaccagctgaaacaactgctgctgaaggccctgactctgatgttggatgcagcagagagttatgccaaggtaacccaaaggcttttttcagactggccttgggacttgctgtctgcagtaaaattattttcttttgtccttgggctctttccaggtgaagcgggagggcatcataggccaaccaggaacagaaggggtgaataccgttgtgagggttcacacaggaggtgacaactaggtctttctctactgtgcctctccacccttgttcctcaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 374190 - DNA, 7551 bp, Homo sapiens
  misc_feature (7511)..(7511): n is a, c, g, or t
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttccttanctgtgtaaagtagtagtagccgcgaatttatgtagtagta

SEQ ID NO: 374191 - DNA, 7959 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaagtaagtattaaaagttgactgtaaacattgctccttgcctctgctttgaggtgagacaagtgtaagaattttatggctaagtacaccatgcctttagattacctctacttaaaatggcaaagcagtatcaagaatccttagaaggaagtcttttaacagatttatgcaaagagatcaacaagaacagtttgctcatagtgctttgtactttaaaatgggaggatagctactcagtgccaaaaacctaaaacactggccaggcccagtggctcatgcctgtaatcccagcactatgggaggccgaggcgggaggatcacttgaggtcaggagtttgagaccagccttgccaacatggtgaaaccctgtctctactaaaaatacaaaaattagctgggtgtggtagctggcacctgtagtcccagctactcgggaggctgaggcaggagaatcacttgaacctggggacagaggctgcagtaagctgagatcgtgccactatactccagcctggcaacagagtgtgactcttgtctcaaaaaaagaaacgaaaaacactaaaacatcagaggtgccttttggagtactaaacttactctataaggtaagcattaacatactcatttttaaagaaatattttatcaagcacccctaatactagtctgagataacccagactccagcaccctctcctctataggtaatagtaagtggtacttcagagctgacagccctcactcaaaatacagtatcctaaggtgggcacagtggtgcacacttgtagtcctagttactcgggaggctgcaagagaagcagctgagcccaggagttcacactctgaaaaaccactgtactccagcctgggcaacacagtgagacctccatcttttatttaagagagaaaaaaaagggcagccacagtgactcacgcctgtaatcccagcactttgggaggccaaggcaggcaggtaacttgaggcccggagttcaacaccagcctagccaacatagc

SEQ ID NO: 374192 - DNA, 6815 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctggggtgagtgaggtcacagccacactaccagaacagtgctgctagctaggtaaaattccttttttttttttttttttttttttttttttttttttttttttttttttttttttttttttttttttttttttttttttttttttttttttttttttttttattccagtttcaaagaaatttaattattatttacacagttaaggaacaggtgatacattttcatttgttagaaactgatctttctgtaataaaatagattttcaattca

SEQ ID NO: 374193 - DNA, 5710 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctatttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgagtggcatgctgcccaaatgtcccaaaggagagcgcccagccgtaagtagaggaactcagttgggcatgactctaagcgcacctcggggg

SEQ ID NO: 374194 - DNA, 2489 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtagtctcattagtcctcttttgataatattagaataccgttagatagtatttcatttatagttgttagtgaacacaagtttcttatgtggaactgagcctgcattctccttggagataaaacttgtatcagacagaagggactcgagagttttctgtcattttaatatttgcataatcagaattatgtgttccccaaaagagtggatgttcttgagcagataaaaaggaatgatgcctttttctcca

SEQ ID NO: 374195 - DNA, 1189 bp, Homo sapiens
ggaggctgagtatctcctgatcacttagttaattttatggggttttttctttctccctcatctgagttatagttctctgtctctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaagtaagtggaataaagatttctacatttgtatttatca

SEQ ID NO: 374196 - DNA, 2424 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtat

SEQ ID NO: 374197 - DNA, 513 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggcttt

SEQ ID NO: 374198 - DNA, 345 bp, Homo sapiens
gtgagctggaccccgcggttatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaaccgcggccgcggttatgtcttacgtactgcctttatgtgagcggtttcatgtgtcgccgtctcttgctaacgtgttgtcatttacgatcgcttttgcgagcatcacgtttttacacgttgttgtcggggaattggcaccgaagacgcttgcaagcgttt

SEQ ID NO: 374199 - DNA, 3662 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaaca

SEQ ID NO: 374200 - DNA, 3523 bp, Homo sapiens
  misc_feature (2)..(3): n is a, c, g, or t
  misc_feature (7)..(8): n is a, c, g, or t
  misc_feature (11)..(12): n is a, c, g, or t
  misc_feature (15)..(15): n is a, c, g, or t
gnntgcnnccnngtngactgactttgctccttcttcgccttctgccatgattgtgaggcctccccagccacgtggaactgctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374201 - DNA, 4204 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcaagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtgg

SEQ ID NO: 374202 - DNA, 3578 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374203 - DNA, 3279 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaaca

SEQ ID NO: 374204 - DNA, 1963 bp, Homo sapiens
tctaacctcttagtaaagtgatttaccaagaactgacaacagcagccaaccagattaggtcaggttgatgattaattgtaactgagcagagaaaccaggtgttgtcatttgaaaacttgagggaaaactgattgatgttctgatttgggttgtagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374205 - DNA, 1574 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatgtgagagacgctgccaggttttctttcttctcaatccgcaccctcctcctttggccatcaggcttcagccagtgtagccgcagccgaaactcaaatcagactagacttttatgaaatgagtgggatttgtagtccaatgacaagggaaacatcatttgtacatagaagtactgtctttctaaccgcaacatcaaattacaatctttctttcacct

SEQ ID NO: 374206 - DNA, 1683 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaagtaagtttaaaggggagccagggaaccagggccgtggtagaagtatacattaatacaaagtatataccctaccaagaggcagctggccttttccctttccagtgatctcctaagttttggatatgattcagttatttttatttggatcttaactgagaagcttacttaaaaaaaaaaaaggatttttgatttacaaggttaataagtgaaatatttattttatttaatgatttcccaaactgttttcattacttctagctttatcaatttatgacatattaaggtttcattgctaatgtcacaggaaagctaaaaagaataataataacaactctcttttaaatgttttactgttttgttaatcacttgccatgtgccaggcattgtgcagagaggtttgtatcattcgcatgtagccctcatatccctttgtggtacataaaacccctgttttactgcaggcaaactgatgcccagagagacgcatcgagtgttccagtcaggaagccaggccctcaggcgccaaagcacgtgtttcagctcctgtgcctaaaaacgtggtccggagctttgtgttagcttaggtttctcttagatttaaaacaaaaaaaaaagtgttgtgttttatttttttgttttgagacaggcgtctcgctctgtcacccaggctgaagtgcagtggtgcgatcttggttcactgcaaccccaacgtcccgggttcaagcaattctcgtgcctcagccacctgagtagctgggattacaaacatgtgccaccgcgcccagctaatttttgtatttttagtagagacgaggttttaccacgttggccaggctggtctcaagctcctggtctcaagtgatccgcccgcctctacctcccaaagtg

SEQ ID NO: 374207 - DNA, 579 bp, Homo sapiens
gttacttagaggatggagtgaatggtggcggagtgatggtggcggagtgatggtggcggagtgcaatggctggcggagtgcactgtgtgtgcggagtgcaatgtgtggctgggtgagtggctgtgcggaggcctgtgttcgggagggcctgggagaaggagggcacccagcaccccggcgtctctggccctttcttattctttggctcctcatccaccgtgatgagaagccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaaca

SEQ ID NO: 374208 - DNA, 392 bp, Homo sapiens
ttctccactgtgtcatctcggtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgatgatgatgactgggatgaagactgggatgggcccaaatcctcttcctactttaaggattcagagtcagctgatgcaggcggcgct

SEQ ID NO: 374209 - DNA, 379 bp, Homo sapiens
attacattaggtttcatttaccacagtttccagttctagtgcacccgaaagacaggacaaggttaaaactggtaagtaaatgtagacgagagttgtaaaattcttacaaggaaagtcttaagactgatgaacatttatattcatgattagatttcctggatttgcgaaacctggcacggaacagtatttgttggccaaacaactagcaaaacccaaagagaaaattcccatcattgtaagtttgtttatttttgtttgctttctttctgattaagctctttcttataccgtactttaaagctaagcgagttattcatcttttggaaagtatttttaaatatatttaatgccccacataactgataatatatgttagtgt

SEQ ID NO: 374210 - DNA, 457 bp, Homo sapiens
gccacgtcaaaataactaattttacaaaccaacttaaaaattacatgatgttttgttgttttctttacaacatatgattcaaagtatggcagtcttgggagttattttcttttagaaaaagtgatctgaatgcttaacactcaataatttagtgtagcacatgcaggatttatagtctttgggtataatagttctcttttccttgattttctgaatttctctgccagtaacaatcagcttgtatcttgttatagccaaagaaagatctccatttcctgatggaatgtaatcacgagtataaaggttttcttggctgcttccctgacatcattggcactcacaaggtaacctgatcgtagacatttatagaagacaacagcaggtgaaggaggcagatgtgcgcagtagtcagtattggttttatatgtttattattaaaaaagaaacaatctataat

SEQ ID NO: 374211 - DNA, 3631 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374212 - DNA, 3800 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacaaaaaaagaaaaaaaaaaaaaacccggggcttttttcgggggggaaaaagggtttaaagggggggtctctgggttccgccccctttttttacagggaattggggcccaaaggggggtaattggagcgtcggttgaaaat

SEQ ID NO: 374213 - DNA, 2941 bp, Homo sapiens
gtagaatagaagtatgaattccgattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374214 - DNA, 3300 bp, Homo sapiens
caagctgctcggggggctgaagcaggagaatgacttgaactgggaggcggccactgcagtaagccgagatcgtgccactgtactccagcctgggcgagtgagactcctcaaaagaaaaagaatatctgtcaattgaccttccaagttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374215 - DNA, 2520 bp, Homo sapiens
gcccagcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaagagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctggctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgta

SEQ ID NO: 374216 - DNA, 312 bp, Homo sapiens
agctctagagaagaaaagttctttcagaattaaaaaaatatatacacatatttctcaaacagtatataggctctgggtttaaaaaagaaaggacagggtgctacagtacttgccatccatttatatttagatggagcccaactgtcctaacagtgtttataaatcttttccagagaagctggaaaacacaccgttttataaaactgcattatagggtttttgctacgagatactgaataagatatataatccacatttccattgttagtcagtagtgcagaaacacacatgatcccaaatgactggggcaga

SEQ ID NO: 374217 - DNA, 455 bp, Homo sapiens
gaggcaggagaatcacttgaacccgggacacagaggttgcagtgagcccagattgcgccattgaactccagcctgggcaacgagaacgaaactctgcctcaaaaaaagaaaaaaagaaaaagaagtaaaaataaagtcaaataaaccaagctttgtggttaaatgagaaagattgtcatacttgatttattttaaagctctagcaatataatatttattttttattatttttaaatggagacagggtcttgctatgtttcccaggcaggtctcaaactcttagcctcaagctgtccttctgcctaggcctcccaaagtgctgaggttacaggggagagccaccacgcccagcccaatgtgatatttaaagagagaaatctaaaacttaagactacagatagaagacaaaggatcagtagaagaaagctgttgaagagtatttagtaacaaaggca

SEQ ID NO: 374218 - DNA, 546 bp, Homo sapiens
cttctcctctctgctctcataaagaagaatgggagatgaaagtggaggggcagctgaggtggggcggcatcaggctgatacaacaccccagggaaccctgcttccatgtaaccctgaccttaaatccctatcctataataaagagttgggcacaacagaagggaaaaggaagtattctgcaaattgttttccataacagtgcagaggacacactttgcaatgtgtaatttgtgcagtatgacatgcatttgggtgtgtctggtcaggtacatcatgtggtgtccctgttatgcattttgcagactgacactctgcttaaccagtccttccgtgctgtgctgttttgtaagctcttaaccagaatgcaaaaatgttaaataactgtctggttttattttccagccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374219 - DNA, 2184 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374220 - DNA, 2211 bp, Homo sapiens
  misc_feature (200)..(200): n is a, c, g, or t
  misc_feature (1071)..(1071): n is a, c, g, or t
atcagggattgccctgcaaactgggggcattgtgggaatatccaagtctctggctccaaagaaagaggtggagtgtgcatcctcctcctcaacctttagaggctggtaaagagtggccttgatgattttcagtggagattctttctcctctgtgggatggaaaatagaggattttacagaggggcttaagagtggataangtgggtgactgttatccatgggtctcaattatttctgagccctggtttgctgcccgtgtgttataacaatgggaattatccagtgctttgtgacacagtagagatccatatgcctacatgtgcatcttagtcatttaaaattgaactctttggatgatttcagttttcactttttgtggcttgtgtttcggtatcacaggaaagtgcctcactccctttcggtattctaccagcatttcattctctgcctcagaagctcccttgccttctgtggcttgaacagcatcttcctctgttggcgtttgtttcaccaaacttactgtgaggccactttattcattttgtcccatggctgcatgacagctaaccctcactctccatgtttacgcttatcacaggtttgaatattggcagcggtgcattcgagacaaagacagctaacaaaattgcttcggaagctagtttttcatctagtgaaggaagtcctttgtcaaggtaaagttgtgaaagcctttctgaatagcagcaacaagatgagaaatgtcacagcgcaatgaattaaactctggctgcgtattattttgttgtatgacttggagggttatggtttgggtttttgtttatctaaaataacagttgaaactttagtctacctttgaaaatatttgcaccagagccaagtattgttttgcagctgttgtttccttggtttaagactcaattgacacctcagtgaaccacaaattagcgtctacagctgctcgcagtaggactgcttagagaccacacaatggaggttgtcagaaaaagggcagagagaaaacatcaggccttaaaagaaataaagtggcatgtttcttctttttgtganggctaatatataaactagtaattgctggatattcatttttattttcctctttttttttaaccaagtgtttaggctaggttattctttccttttctaatactttcttgcttattttccataaagaacaaaatttatcttttcacatttgtcaaactgtagcactcgcttcttgtaggttttttgagctgtgataagagagttgtgtgctgaatttgtcattaacataaaatactaatcacagtagcttcaggtcacttagaatttatagatgggaatataagccatcacctgatgaaataccctactcttttgctttgagctaaatattgtttaaaatggcatagcaactttccttttggaacagcattgctcagtaaaaaggtgtccttcagatgattatattacatttgaattaactgcttgtctctgatgaaattttagaacaggaactttacatttctagtataacatataatgttccataagagaaaatgatttgaaccagaaatgctgaattttttaaatgaaaaaaatcctatttttattcatattttataaacaatacaatgtttttagaacctggagtatattaaaatgagattgaatttctaaaattataagttttagaaacttgacaagttaagttttagagaaataactcatttaattttcagaagttattatttttaatgcctgagttttcgtccatatttttgaaggaagtgggaggtaaatgggacaggaagagtgttaaagtattatgttattatgattgtattataaattcaagttctaggtctcctaaaagaaagtttaaaagacagtaaattctacagataattttcagggccgaatgttaccatttggcttaataatatatagaggcactaaaaaactcacttcttcctaaacagtctttacgtaggttctttgggaaatttttaaagacattgagaaagcaattggattttgtaaaacatttctcagtctaataatttcacatcttgtctatattttactaaactaaaatcaagcattttcctccttcaaattgagacagaggtattttgttattagtatcgtttccgtatgaaattaatttcctaataaattacaagtaatctcatcatcccctttaag

SEQ ID NO: 374221 - DNA, 524 bp, Homo sapiens
agaaaatacatcaattaatacatattttgttgcccagccctgtgtgatccttctctctctctgcagtatgcataatgcatagaagcatagtgaagacttggaaaagactttcagcaaaggaattgtttaaaaataaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374222 - DNA, 486 bp, Homo sapiens
tgcctgagggctttctctggctgcaggagcgtgctcagccctcacaaggcagcccaaagtaccagggagttgatgccctgggttgagagcaaccctcaaccaacagaggcaagttggtggatcagtaaccccactcccttgctcttcactgggacaatctggggagagttctgcagtctctcagggggccccagcaggctgagccttgcctgtccactcactgccaggcacccactcgtcatcatacccttcattggcttcctgtcttccttgtgtcactgtccccatggttcctgggatcacctctcaagtaaatgatgtggaccaaagtcctgtctcaggccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374223 - DNA, 2021 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374224 - DNA, 1987 bp, Homo sapiens
gggacacctgtctgagcagtatgtgccagacagctgtgtagtacaaactagtaatgacacacagggcttaaataagtctgacaacatagatggaaaggcatctcttcagattggtgagaaaacgccagtcacagccagtgtattgtctgaggaggaacaaactcattgcttggagataggaagtaacacacgtcatggcaagagtaatttatctgaaggcaaaaagtccgctgactcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374225 - DNA, 2130 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374226 - DNA, 861 bp, Homo sapiens
taagattcagccctcaaaaagtgtattattgtgagggtaacttgtaaagaattagattatagtagaaaataaccaggtgttttttttcttgacattttaatttcatttaaatgtgggaaacagattaaatcctaagtaaagcttaacttaaaattatatttgaaggctatctttgagaccaagaggaatgtggctacagtttgtttttatttctttgtgctttttttgaaacactgtaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374227 - DNA, 2506 bp, Homo sapiens
  misc_feature (2320)..(2320): n is a, c, g, or t
  misc_feature (2445)..(2445): n is a, c, g, or t
  misc_feature (2468)..(2468): n is a, c, g, or t
  misc_feature (2473)..(2473): n is a, c, g, or t
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaaaaaaaaaaaaaaaaaaaaaaacctcgtgccgaattcggcacgaggtgacgcggtacagctgcccaagggcgttcgtaacgggaatgccgaagcgtgggaaaaagggagcggtggcggaagacggggatgagctcangacaggggtttgtgaagaagtccaggaaccgaggctttcggtggtctataagtacgccgaatcgcagttggaaccaccactttttgcagatatatactcatttatagagccgaggcaagagagtnagacgccgcaagaaaatgccaanagccncggagaggcccaacctgttgaagacccccagac

SEQ ID NO: 374228 - DNA, 3908 bp, Homo sapiens
  misc_feature (2372)..(2372): n is a, c, g, or t
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggtaaagttgtgaaagcctttctgaatagcagcaacaagatgagaaatgtcacagcgcaatgaattaaactctggctgcgtattattttgttgtatgacttggagggttatggtttgggtttttgtttatctaaaataacagttgaaactttagtctacctttgaaaatatttgcaccagagccaagtattgttttgcagctgttgtttccttggtttaagactcaattgacacctcagtgaaccacaaattagcgtctacagctgctcgcagtaggactgcttagagaccacacaatggaggttgtcagaaaaagggcagagagaaaacatcaggccttaaaagaaataaagtggcatgtttcttctttttgtganggctaatatataaactagtaattgctggatattcatttttattttcctctttttttttaaccaagtgtttaggctaggttattctttccttttctaatactttcttgcttattttccataaagaacaaaatttatcttttcacatttgtcaaactgtagcactcgcttcttgtaggttttttgagctgtgataagagagttgtgtgctgaatttgtcattaacataaaatactaatcacagtagcttcaggtcacttagaatttatagatgggaatataagccatcacctgatgaaataccctactcttttgctttgagctaaatattgtttaaaatggcatagcaactttccttttggaacagcattgctcagtaaaaaggtgtccttcagatgattatattacatttgaattaactgcttgtctctgatgaaattttagaacaggaactttacatttctagtataacatataatgttccataagagaaaatgatttgaaccagaaatgctgaattttttaaatgaaaaaaatcctatttttattcatattttataaacaatacaatgtttttagaacctggagtatattaaaatgagattgaatttctaaaattataagttttagaaacttgacaagttaagttttagagaaataactcatttaattttcagaagttattatttttaatgcctgagttttcgtccatatttttgaaggaagtgggaggtaaatgggacaggaagagtgttaaagtattatgttattatgattgtattataaattcaagttctaggtctcctaaaagaaagtttaaaagacagtaaattctacagataattttcagggccgaatgttaccatttggcttaataatatatagaggcactaaaaaactcacttcttcctaaacagtctttacgtaggttctttgggaaatttttaaagacattgagaaagcaattggattttgtaaaacatttctcagtctaataatttcacatcttgtctatattttactaaactaaaatcaagcattttcctccttcaaattgagacagaggtattttgttattagtatcgtttccgtatgaaattaatttcctaataaattacaagtaatctcatcatcccctttaagaaaacaaaaaaaaaaaccacacaaaaaggccttgaaggaactcttggttctaggcacttgataataatccagtgatgaaaaggtctgggtccagagtgcgtgggtttggcgtgctgtttgtcacggtttggttcttgtgctgggcttggtgttgttcatatgccaccctgggctttggagagctccagttttgctgtttgtgctggattcactgaaatttcttagaggcttacatttaaggatcccacttactgcagtcactccttgtgctttattgcttttacaagtggtctcgaaacccggtacttgagaataaacataacagtgcagtgctgctgtagcacttttaaaattcttctttgctctattttgtcagtgagctgatgagcaacctca

SEQ ID NO: 374229 - DNA, 2416 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaaccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374230 - DNA, 1636 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggtaggtagctaaactgtctgaagttttcccaatcacaaatgtggaccacagggtaaggttagtaatttttattt

SEQ ID NO: 374231 - DNA, 2242 bp, Homo sapiens
atatttgcagggtttcctgtgtccagaagaacaaggccctggctgtgagaagggcggtggtggtgcgtggggtagggcaaagtgtcgagccatgcaccaagaatggtttctctcccaacatctcctgtgaccattcaggcaattctgaaagaatctcagcatcataaaacattcgagtgacactccctgaggagacttttaaattcattaaaattgcaaaagctcctgaaaaggcacacagagaaatcatatcccgtggagccagttttcttgtcatattggcctcagtcgagacggtcctggacgccacgaacactagcatttatgtgacacttgcagggccctctaccaggtgtttgttttgaactcctttcttaactgttagtattgctgccactggtttgactaagtattttaacttccttaccaacatcttgaattccctactgcaagtgtttcatttttagcttgcctgaaagcactgaagtttgatgcatcactgtcttccagaagactgttgagggaaaccggtcccctgcctcaggggaacatgcgatcatcctcccccaagaacacgtggccccacacaggcacagctcagcagggcggggtgggccatgcagacctgccgaggggacacacgcaggacgggagcaatgctgttgagtagcgaccctcccgacaaggccacgctgcatcccgatattttccctttacttttaaactctgggaagtaagtgtaaagttctggcctccagtgaatcaaagtgcttcttctctaatgcgttcattatgaaaatattagtctcattgtcttttctttttcagaacttagactgtttctttattttgcaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaagtatgaatttgcaggggatcctggcctccatgtctaattaattatcagcaccctgtattttaccaatgaaatgtttcttgcctctctcctcatcctcagaagcacccattgctcatgaccggacaggctcttggagtaactctaactggtttcctcatacccagttcctcccagctcctgggaactcccagctcctccacctggccaccagcctccaaaccctggcttcccccgaccttcctgtgtaaggacggccaatgcctccccgtaccttcagggtagagtctgagctttctccattcctgggaggccccagccctgctctccagcttattcctcccaaggtcgcctctttgggtcaagccacagtcagcttttttcagctgtagcacacctatgcctctgtacctttgcccatgttgttccttctgtagggagttccttttccttttcctcagcccagtgagctcctattcatccttcaacacccaactcacgggaaaaatctagccctcctaccataacactgtggcatatcccctgcccagcttgggctctctcacctcctgtctccttaaaccccttataccttaaattaaaggtataatttgattaatagttttactgacaataacaaaatgattcagagctgctgtagaacctaggcctaggaatctgcctttttagcaagcaccccactgtgaatcactcttctagaaggacagctacctactgtgggggagacaagtacccagtgggttgtgatggagagtatgggcttgagtcagatgacttggatgggactcccagcttggccactcactggcattgtgattgtggccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcagct

SEQ ID NO: 374232 - DNA, 2435 bp, Homo sapiens
  misc_feature (899)..(899): n is a, c, g, or t
agaaaatacatcaattaatacatattttgttgcccagccctgtgtgatccttctctctctctgcagtatgcataatgcatagaagcatagtgaagacttggaaaagactttcagcaaaggaattgtttaaaaattgttttatttttaaaaagaagaaagaaaaggcagaagtctggcaagaccaggaccactttcccaccaggcagcaattggctgaagccaaggagcagctgtgctctatagacaagtcatgtgcctccttgcctgctacagggcaggcccttcctgctgctcctgcctggccatagtcacttattggagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggtaaagttgtgaaagcctttctgaatagcagcaacaagatgagaaatgtcacagcgcaatgaattaaactctggctgcgtattattttgttgtatgacttggagggttatggtttgggtttttgtttatctaaaataacagttgaaactttagtctacctttgaaaatatttgcaccagagccaagtattgttttgcagctgttgtttccttggtttaagactcaattgacacctcagtgaaccacaaattagcgtctacagctgctcgcagtaggactgcttagagaccacacaatggaggttgtcagaaaaagggcagagagaaaacatcaggccttaaaagaaataaagtggcatgtttcttctttttgtganggctaatatataaactagtaattgctggatattcatttttattttcctctttttttttaaccaagtgtttaggctaggttattctttccttttctaatactttcttgcttattttccataaagaacaaaatttatcttttcacatttgtcaaactgtagcactcgcttcttgtaggttttttgagctgtgataagagagttgtgtgctgaatttgtcattaacataaaatactaatcacagtagcttcaggtcacttagaatttatagatgggaatataagccatcacctgatgaaataccctactcttttgctttgagctaaatattgtttaaaatggcatagcaactttccttttggaacagcattgctcagtaaaaaggtgtccttcagatgattatattacatttgaattaactgcttgtctctgatgaaattttagaacaggaactttacatttctagtataacatataatgttccataagagaaaatgatttgaaccagaaatgctgaattttttaaatgaaaaaaatcctatttttattcatattttataaacaatacaatgtttttagaacctggagtatattaaaatgagattgaatttctaaaattataagttttagaaacttgacaagttaagttttagagaaataactcatttaattttcagaagttattatttttaatgcctgagttttcgtccatatttttgaaggaagtgggaggtaaatgggacaggaagagtgttaaagtattatgttattatgattgtattataaattcaagttctaggtctcctaaaagaaagtttaaaagacagtaaattctacagataattttcagggccgaatgttaccatttggcttaataatatatagaggcactaaaaaactcacttcttcctaaacagtctttacgtaggttctttgggaaatttttaaagacattgagaaagcaattggattttgtaaaacatttctcagtctaataatttcacatcttgtctatattttactaaactaaaatcaagcattttcctccttcaaattgagacagaggtattttgttattagtatcgtttccgtatgaaattaatttcctaataaattacaagtaatctcatcatcccctttaagaaaacaaaaaaaaaaaccacacaaaaaggccttgaaggaactcttggttctaggcacttgataataatccagtgatgaaaaggtctgggtccagagtgcgtgggtttggcgtgctgtttgtcacggtttggttcttgtgctgggcttggtgttgttcatatgccaccctgggctttggagagctccagttttgctgtttgtgctggattcactgaaatttcttagaggcttacatttaaggatcccacttactgcagtcactccttgtgctttattgcttttacaagtggtctcgaaacccggtacttgagaataaacataacagtgcagtgctgctgtagcacttttaaaattcttctttgctctattttgtcagtgagctgatgagcaacctca

SEQ ID NO: 374233 - DNA, 1813 bp, Homo sapiens
agaaaatacatcaattaatacatattttgttgcccagccctgtgtgatccttctctctctctgcagtatgcataatgcatagaagcatagtgaagacttggaaaagactttcagcaaaggaattgtttaaaaattgttttatttttaaaaagaagaaagaaaaggcagaagtctggcaagaccaggaccactttcccaccaggcagcaattggctgaagccaaggagcagctgtgctctatagacaagtcatgtgcctccttgcctgctacagggcaggcccttcctgctgctcctgcctggccatagtcacttattggagaaacagaagcctatcagttgctgaagaaggccacccttcaggataatacaaatcaaactgaaaacaggtttcaaaagacagatgcttctgtgtcacacttgtcaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaagtatgaatttgcaggggatcctggcctccatgtctaattaattatcagcaccctgtattttaccaatgaaatgtttcttgcctctctcctcatcctcagaagcacccattgctcatgaccggacaggctcttggagtaactctaactggtttcctcatacccagttcctcccagctcctgggaactcccagctcctccacctggccaccagcctccaaaccctggcttcccccgaccttcctgtgtaaggacggccaatgcctccccgtaccttcagggtagagtctgagctttctccattcctgggaggccccagccctgctctccagcttattcctcccaaggtcgcctctttgggtcaagccacagtcagcttttttcagctgtagcacacctatgcctctgtacctttgcccatgttgttccttctgtagggagttccttttccttttcctcagcccagtgagctcctattcatccttcaacacccaactcacgggaaaaatctagccctcctaccataacactgtggcatatcccctgcccagcttgggctctctcacctcctgtctccttaaaccccttataccttaaattaaaggtataatttgattaatagttttactgacaataacaaaatgattcagagctgctgtagaacctaggcctaggaatctgcctttttagcaagcaccccactgtgaatcactcttctagaaggacagctacctactgtgggggagacaagtacccagtgggttgtgatggagagtatgggcttgagtcagatgacttggatgggactcccagcttggccactcactggcattgtgattgtggccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcagct

SEQ ID NO: 374234 - DNA, 1426 bp, Homo sapiens
cggacgcgtgggcttttctctgtcttcatctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374235 - DNA, 2228 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaaggttgggttctccctgaagcagacctggagaacagggatttgacgctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374236 - DNA, 1931 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374237 - DNA, 1858 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 374238 - DNA, 3383 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaagtatgaatttgcaggggatcctggcctccatgtctaattaattatcagcaccctgtattttaccaatgaaatgtttcttgcctctctcctcatcctcagaagcacccattgctcatgaccggacaggctcttggagtaactctaactggtttcctcatacccagttcctcccagctcctgggaactcccagctcctccacctggccaccagcctccaaaccctggcttcccccgaccttcctgtgtaaggacggccaatgcctccccgtaccttcagggtagagtctgagctttctccattcctgggaggccccagccctgctctccagcttattcctcccaaggtcgcctctttgggtcaagccacagtcagcttttttcagctgtagcacacctatgcctctgtacctttgcccatgttgttccttctgtagggagttccttttccttttcctcagcccagtgagctcctattcatccttcaacacccaactcacgggaaaaatctagccctcctaccataacactgtggcatatcccctgcccagcttgggctctctcacctcctgtctccttaaaccccttataccttaaattaaaggtataatttgattaatagttttactgacaataacaaaatgattcagagctgctgtagaacctaggcctaggaatctgcctttttagcaagcaccccactgtgaatcactcttctagaaggacagctacctactgtgggggagacaagtacccagtgggttgtgatggagagtatgggcttgagtcagatgacttggatgggactcccagcttggccactcactggcattgtgattgtggccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcagct

SEQ ID NO: 374239 - DNA, 3440 bp, Homo sapiens
agcggaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcaggaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaagtatgaatttgcaggggatcctggcctccatgtctaattaattatcagcaccctgtattttaccaatgaaatgtttcttgcctctctcctcatcctcagaagcacccattgctcatgaccggacaggctcttggagtaactctaactggtttcctcatacccagttcctcccagctcctgggaactcccagctcctccacctggccaccagcctccaaaccctggcttcccccgaccttcctgtgtaaggacggccaatgcctccccgtaccttcagggtagagtctgagctttctccattcctgggaggccccagccctgctctccagcttattcctcccaaggtcgcctctttgggtcaagccacagtcagcttttttcagctgtagcacacctatgcctctgtacctttgcccatgttgttccttctgtagggagttccttttccttttcctcagcccagtgagctcctattcatccttcaacacccaactcacgggaaaaatctagccctcctaccataacactgtggcatatcccctgcccagcttgggctctctcacctcctgtctccttaaaccccttataccttaaattaaaggtataatttgattaatagttttactgacaataacaaaaatattcgctgtttatttagccccagtatgtcccactttgctaacccagtatggaaactgattcagagctgctgtagaacctaggcctaggaatctgcctttttagcaagcaccccactgtgaatcactcttctagaaggacagctacctactgtgggggagacaagtacccagtgggttgtgatggagagtatgggcttgagtcagatgacttggatgggactcccagcttggccactcactggcattgtgattgtggccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcagct

SEQ ID NO: 374240 - DNA, 235 bp, Homo sapiens
gggcacctggggctcagtccagacgcagcgcagcctagtgggtgcacctgggagtggtctgcccaggggtgacgctccggccagcccaggctcagccagggggctctgggtgacagtgtaggctccaggctgagggttgccctgcggggtgccagctctcctgctagtcctgccctgtgtgcctgctgaggctcagacagggatgtggtatctccaggaagctgcttggcagaat

SEQ ID NO: 374241 - DNA, 317 bp, Homo sapiens
tttttacttttcaaacttttgttaaaaactaaagtcacaaaacatgcacattagcctagacctccaaaaggtcgagatcattaatatcattgtcttccacctccacctcttgtcccactggaagatctttagggacaataacatgcagggagctgtcatctcctatgataacaatgtcttcttctggaatacctcctgaagtacctgcgtgaagctgtcttacagttaatcatttttataagtagaaatatatgctaaaataaagacagtatatacatcctaaaatgagtagaatatatacataaatcataaaatag

SEQ ID NO: 374242 - DNA, 2130 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccaca

SEQ ID NO: 374243 - DNA, 3143 bp, Homo sapiens
agtttcagcggtttgtagtttgtagcggacaacatggcggccttcatgctgggctcgctgctgcggacgttcaagcaggtcaggcctctacttttatccacaccgctacccctcaccgctgaatctcataacccacgggtcccccacggctctgccacctgtagtgctcgatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374244 - DNA, 3007 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaacccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374245 - DNA, 3009 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcagtgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374246 - DNA, 2519 bp, Homo sapiens
gcggccgcctactactactactactgctcgaattcaagcttctaacgatgtacctggacatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374247 - DNA, 583 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggagggtttgatgaagggtttgatgacagggtttcgatgaggggtttgatgaagggtttcgaatga

SEQ ID NO: 374248 - DNA, 525 bp, Homo sapiens
agtttcagcggtttgtagtttgtagcggacaacatggcggccttcatgctgggctcgctgctgcggacgttcaagcaggtcaggcctctacttttatccacaccgctacccctcaccgctgaatctcataacccacgggtcccccacggctctgccacctgtagtgctcgatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcagaggttagctaattaagatgagtccctttgtaccacaagatcattaactcaacatcagatcacttttgatactgtttgttgtgacttggtatcaatataatttctggagaataagatccacatcaatataaacaaatagtcttgaaactgattttgttgagtttcaaattaaagactattcactcccaaaaaactta

SEQ ID NO: 374249 - DNA, 3051 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374250 - DNA, 1670 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagatggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccaca

SEQ ID NO: 374251 - DNA, 2998 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactagctttgctgacctgcagagctccccttaactattattgttagataaacagattggatagcaaggctgctgttctggattatctaatgctccacttcttcttgtgatggctgaacaaaagaaccactaagtgttttcttgtccatccttaagggactttaaaacaaattatgcctctttaagtccttgaaagtctccatctaaagaggaaaagtttgttggaacagtatatattccctatttttatgtttatttaatccataacagaaatgagtaagggtagcacaaagttctcattcagtaactcaacagtgtgatcatcagcccagtgataaaaatatacatactgaatggaagtacctacttaacatcaggaaaatattcctggagaacttaataaatcaggaggtgaggggtgagatttttttctgcacacagagggaacaaaagcacaaagaagcaaaggcactctgtagcatcagagaaccacagtcacttcagtagatcagaaatatgaagcacaagacaaggcccgtattgtggaggatctcacaaatcatgtgaaggaattaagactgacataccaggtattacagagttttaagcacaggaatgacatcatcagtttgtaatacaggtaagtgacagctgtgtggcagatggccatgagaggaaaaagctacaggcaagacaaccagttaggaggatgtcttagttgttgaggaagatgaaggcctgaactaacattgtggtattagtagaggagagaggacagatttttaaagttttaggaaagaaaattgggcaagacttacaagactgattatatctaagaggtaaagatggttctctgggttcctgataaaagtgtctagatagatggtagagggcaattccaagagggcaactccaagatagaaaatttggaaaaagaacaaatttaggggaaacagaagataagcgagttcaggttccagtcatgcggtgttggagatgcctgtgtcatctgatgaagactagtacgcagctggatagcagagtccgaaactcaggtggaggtgaagttatgagggaattatcacaatctagtttggattcatatttcttaaatatgtatgacaacttaccaactggaatgttctagctaatatctcaacttagaatccatctcactaccaatgggcaaacacttgtgttctaaagttacttgcaagtagtttatactgccaacttgatatatatacatgctatagtttgaacattttgtgtacttccaaaattcacattaaaatctaatccacaatgcgttggtattattaagaggtggggcccttaggggtgattaggccaggagggctccacactcatggatgggatcagtgcctttctaagagggcttgagggagagagtttgtcccttttacccttctgatactgcgagaaggcaccgtactggaagcagaaagcaagcccttaccaaacaccaatctgctggtgccaaatcttagacttctccagcctccagaagtgcaagaagtaaatattatttataaattcttagtctatggcattttgttacagcagcaggaatagactaagacaatgtgttgataggtttagggtcatgttttactttttcagtcatgttaaattttagatggttctaaagtcaaaactctagaaaaagttaaattcacagaatagcttccatcctcatctccttccttcccctgctaacaatttttattagctttgggtttactcgtttctttttgaaacataagcaaatacacctatgtgcatacattcacatttctcaccctttcttacacaaatgtagtgggtataccataaatgttctgcactttgcttttccacttactctatcctggagaccattttacgttatatagaactcttcattgttttgtgacttaagtactccctcatgtggatgcaccataatacattcctgttaaatagacacgagtatttttaatcttttgcatatagcattccaaatttttctaaatgtacctttcagagcccagaaagaagttaaaattctgggtcaaaggataaatgaatatgtcattctgatggttattaccaaatactctttctgagacaagagtcttactctgtcacccaggctggagttgcagtgagccgagatcgtgccattgcaccccagcctgggtgaaagagcaagactctgtctca

SEQ ID NO: 374252 - DNA, 607 bp, Homo sapiens
  misc_feature (505)..(505): n is a, c, g, or t
  misc_feature (571)..(571): n is a, c, g, or t
  misc_feature (577)..(577): n is a, c, g, or t
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaagtgnaagatgctttctacaaaggtgaactcaggctgaatgaggaaaaattatggaaagagcaggacggtnagtggnagatacattggatcttctcattggagaggt

SEQ ID NO: 374253 - DNA, 796 bp, Homo sapiens
agtttcagcggtttgtagtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatgcctcaactcaatacagttgtttttatacttctttttcaagtgaaaggtaaaaacactggtttattctcttctgaacaaggttctcaatctgttacccaagctgcagtacagtggcatcatcatagctcactgcagccttaaactcctgggctgaagtgatcctccagccttagtagctgggattacgggcgccagccttcatgcctggcttcaattgctttctctgatctaactgtgttggctaatacctccaggaaaataaagtaatggagatcacaggcactggtcctgacttcagggggaataggagtaattcctactaaaagcctgatttttctgacatactcctagacaaataaatcataaaactgttctaatga

SEQ ID NO: 374254 - DNA, 1871 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaagcacaaacacaaagtaggatcccagtgcattaggcagccagtctcgggagaaggggaacttgtgccccagaaagggcagttacccggccagggtcacatcaaccgccagaagtggagttgggcagccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374255 - DNA, 1426 bp, Homo sapiens
ggacgcgtgggtcgcggacgcgtgggtccggacgcgtgggtcgacccacgcgtcggaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374256 - DNA, 1764 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttgggggtgattttgcctatgcaggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374257 - DNA, 1703 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374258 - DNA, 1890 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaagcacaaacacaaagtaggatcccagtgcattaggcagccagtctcgggagaaggggaacttgtgccccagaaagggcagttacccggccagggtcacatcaaccgccagaagtggagttgggcagccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttgggggtgattttgcctatgcaggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374259 - DNA, 1745 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374260 - DNA, 1560 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374261 - DNA, 1691 bp, Homo sapiens
gtccgagaccaggagtaaggggacaggagcgaggactgatgccactgtagaaggcgaggtctctagacccctctcacctgtggggtgcacaggtgcctgcaaccaggatggtaacccagaccaggcagaagcaagctaagagaaaacgttgggtccctgggcctggcctcgccctcccagttggaggctaacggtgcggaggttccctccagcactcgctccttacagccctccccacctagcccagcccagcccagcccagcccagctgaatttgctcttgggtctttaaggggcgggaactgccaccaacgcgcatggctgcgtcattaacttgcgcctctggcctgcgcctccacgtggatttggtagagaaaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagtggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374262 - DNA, 1262 bp, Homo sapiens
ggacgcgtgggtcgcggacgcgtgggtccggacgcgtgggtcgacccacgcgtcggaccccggactgggatcatggcagccgagactcggaacgtggccggagcagaggccccaccgccccagaagcgctactaccggcaacgtgctcactccaaccccatggcggaccacacgctgcgctatggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccct

SEQ ID NO: 374263 - DNA, 986 bp, Homo sapiens
ggacgcgtgggtcgcggacgcgtgggtccggacgcgtgggtcgacccacgcgtcggaccccggactgggatcatggcagccgagactcggaacgtggccggagcagaggccccaccgccccagaagcgctactaccggcaacgtgctcactccaaccccatggcggaccacacgctgcgctaccctgtgaagccagaggagatggactggtctgagctatacccagagttcttcgctccactcactcaaaatcagagccacgatgacccaaaggataagaaagaaaagagagctcaggcccaagtggagtttgcagacataggctgtggctatggtggcctgttagacactggtgacatcagcatggagaggctccacctaccctctactctgggtctgtgacctttgccctggagagtggagggggctgcctcaaatgcttcttaaaacctgggttgtcctttctggcgtcaatccctacatgagccatttcatctgccaggttccgggtcagtgagctggtcagcacaagcatcagagattagccgttgtggccagtgatcctgaactgtcttttctcagagattctaccatctcccctcccctttgcccctccctcgccagatctcattccttctgccccactctcctgttttttgggattacaggcatgagcctgaactcgagttgaatagaatatggggagcttggactgggggtgtcactgtgtgaaggtcgcctccaggagctgatggggagaggttgtacttaccgtgttgttctgtttcaggtattttgcacttggactgctctatcattataataaccaagatgctgctgcagttcaggtgagtctagaagggtttccacatgatttaaaaatcagcaccatgtaagtaatacttagtgttacttaaaaaaaattcacaagttgatagagaccacttttgcctgatctacacccttttaatacagaataaaaatga

SEQ ID NO: 374264 - DNA, 562 bp, Homo sapiens
ggacgcgtgggtcgcggacgcgtgggtccggacgcgtgggtcgacccacgcgtcggaccccggactgggatcatggcagccgagactcggaacgtggccggagcagaggccccaccgccccagaagcgctactaccggcaacgtgctcactccaaccccatggcggaccacacgctgcgctattgcccctccctcgccagatctcattccttctgccccactctcctgttttttgggattacaggcatgagcctgaactcgagttgaatagaatatggggagcttggactgggggtgtcactgtgtgaaggtcgcctccaggagctgatggggagaggttgtacttaccgtgttgttctgtttcaggtattttgcacttggactgctctatcattataataaccaagatgctgctgcagttcaggtgagtctagaagggtttccacatgatttaaaaatcagcaccatgtaagtaatacttagtgttacttaaaaaaaattcacaagttgatagagaccacttttgcctgatctacacccttttaatacagaataaaaatga

SEQ ID NO: 374265 - DNA, 906 bp, Homo sapiens
gttccttcatgtctttttgatggcttgatagctcatatctttttatcgccaataatattccattgtgtggctgtactctagtttgtctatccatgcatgaagcttactgttttacacaaatgataggacatttcagcacatagcagttgtttgataaatagtcattaaatgacctagttagatggactgcttaatttttctgccagatatgtagtgccaagggagagttgtgatggaaaaggcaattatgttgttaggcactgacttctgttaatgtacagttaatgtttaagtggcttagcccagcaaaggtaggtggctttgatgtgtccaggcttccaacagcagtttcttaaattctctttagagctgcactgtccagtatggtagccactagaaaagtctggaaaaatagccacatgtgtctatttgaacttaaattgattgaaaagtaaataagatgaaaaattcagtaccttggttgtactagccacatatcagcgactcaatagccatatgtggctatttgctgttatttcggacagtgcagatgtagaacatttccatcatcacagattttattagacagccctaatgcaaataaaagcattcagagagaaggatgggattgaaattagttgaccaggctgattctggtttctctttaatgcttagctcttttgtgccacaattttacaatggaagagatgaagctcagaggtctgtttgctgaagaacagttgcttaagatgactttggggataaaaaggctgccaggccagtgaagctgtgaaatgccccctgtgtgacagccccaggcggcatggcttgacaatggtttaggcccttgatcagctagtgttaaggagttttacagaactctcagctcttgcttatttagtttgg

SEQ ID NO: 374266 - DNA, 1138 bp, Homo sapiens
actggctcccccaacagtggactgaccccggagtcaggggccgaggagcccttcctgtccaatgccagctccctgctgtccctgcacgtggacctggggccttccatcctggatgatgtcctgcagatcatggatcaggacctggacagcatgcagatccccacataggacacgaggctgcctaggctggggtcccaggtggggcccagccaggaggtggggtgtggacccggccctggcggcggagtcagggtcccaagatcccacctgtatggtcgctggccagtgattctccttctgagccgtgtttcccctctccctccctctccacgtgggcagggcaggccccatcgctttcctctgataaccacatggacacatcctgaagtcagcccaggcgccctgagcatcttggggcacctggaccccatcacaatactccttcttccttcaggtccctgggtgaaggctttgctgaaaccgaccccccttttcacgtcccttctgcctctgccccgttggatgccctgactgggggcaggggaagagacagggcacagctggccacagggctcagccactgagcaggctgttccgggcctttggctttgcatcctggacggggagtgtcctgtcagggaccagatgtgtcctgcctcatccctagctccaatcccttccccacgtgaccggggattctggttgcaataaaacatgctgctgctggtggcggagctccctgtccctttgccccaggtttcctcccggaggcagacagtctcccagagctgagggcttgcctctggagaccccagccccagagggctttgtggaggacaggccttgccctcaagaacgtcgtacctgacgctgagcctgtcatgagaatgcaacaggagcaaaccaagtgttgctgtgacattgattcagatgtttggcaagaggtggctgagcactcgggtgggcttggcactgtgccaagcctggggccaatccctgcccagtcagctggggtctggtgggggacacccaagaataaaagaataacccacaaagtgtgcaagggaccaacagcttctccagcttaagagcaccgagggagcatgcaggagggatgcttggagctgggagggtctaa

SEQ ID NO: 374267 - DNA, 545 bp, Homo sapiens
taaacatatacctgacatatgaaatgaaagaatatgtctatgaaagactggtacacaaatgtgtaacagctgtctttgtaatagctaaaaagctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374268 - DNA, 475 bp, Homo sapiens
tatttaattcatccaaaagactgttgcaaaatttattttctttgcatgttcctaccccattcaagaatattcattatgagttataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374269 - DNA, 415 bp, Homo sapiens
tatcctgtagggttgtttttaggatcagatgaaataagacaggaagataaatgtaaagagaaaaaacatgcatgcgtattactgcaactgtttattaatatcattaggaataaccttttatagacttgcaaataactgttggtattttgttgataattatggattttgcttgatgtaaattgttgtgggttaactcgatatttgaatgggcagggccatataatttgcttgcatgagtttttaactagctgtccccccctctccccggtttaattttacaggcaacagatattaaggaggcatctcaaaaatgcaaacagaagcaagatgttatagaaaggaaagataaacatagttttaaatatttaaaaatgtgcaagttgctttgctataataaaactaaatgcatacatac

SEQ ID NO: 374270 - DNA, 407 bp, Homo sapiens
ataagctattacaagctgtattatttccttttaagatctcttaagtcgaatataaggaaaaatttaggcacaggaccatgatatagttagcacacagtgagtgtgatgcgatgtgatgtttcaagtctgcagaataatattgaactatttaataaaagatgctaaagtagtgggttagttattgggaaaatgaaatgataaattatcccttcataatgcagaaacaatttccaaaaggactaaatgtaaaaaatgttaattataaaataattataagtaaatatcttaatttggaatataagtaagcattctaaacataatagaagaaatttaaaaagagtagtttgtaatcataaaaagcttaagcttttctggtaagtgaataagtcatatgtgattttaaaata

SEQ ID NO: 374271 - DNA, 5972 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374272 - DNA, 5927 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacagttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374273 - DNA, 5256 bp, Homo sapiens
  misc_feature (15)..(15): n is a, c, g, or t
tgatgccattacaantgatctgagacggattcaggatgaaaaggcattatgtgaaggcgaaataattgacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374274 - DNA, 3556 bp, Homo sapiens
atgtactgattgcctcccctcaaaaaaaaaagtatatgttctaatttgtccccatggcatggactcagaagatagtactgtggtgaaattcaactgtcaaagtaattagattctcaggatgcttttttagttcttcataagtgcagtataaagttctaacttcttgctctctttcaatgccccacatattctggacccattctaccaattcagcaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374275 - DNA, 3433 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgagacaggcaaaggccaggtgctgtggcttatgcctaatcccacttttataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374276 - DNA, 3034 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacagtaagtataaaaagtatataatgctacaattgccatatttaacatttttaagattatggaatcttagccattgtaacaggccgtgaaaaacatgatgtgtcgtaaaaaatagggagtttttccacatttttaaactgaatatatatatatatataaaataatgttgcttaagagatcaatggtattggtactataacatttattcttccaatacaaatgccttttaatgggtacagttggaacatatatagtttttcatggaaacattgtaccagtaattggtatatcagaaataataaatagaatattttaaaaataaagggaaaatgaaaatgtttccctggaaattggggtgtttaattagggttcaatgagagctgaatatttaaggctaacatctgccaa

SEQ ID NO: 374277 - DNA, 1618 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacggtaagaaactttgttcatcttggtagtattggttttattattgtaatc

SEQ ID NO: 374278 - DNA, 632 bp, Homo sapiens
tgtttttaaaattttggccagagtttacaatcattgtttgtagaaaagttagtccaatacaagataatctgccaataatgtaagcataactatctcccttctgtatcattttgaagtaattcccagacattctgtttcacctgaaaatattttggtatgtatctctaaaagaagtggactctttttataaaaacacataactacagtattatcacagtaaaaaaatttatactaagtaacatctaatatgccgtgttcgagtttcttatccatcccacgaatgccagtaggagtatggtaactataaatcatttcagtagagaatatatggtaattaaaataatattttcttttccctatattcaggttcgtgacaataaaaaattaagagtaaatgctgttattgctcccaagagttcatatgcagacaaagcaccttcaagatctttgaatgaacttaagtaagtcttgaaaatactaagatttatttaaatattgaattattcaacatttattgttacataaataagctattacaagctgtattatttccttttaagatctcttaagtcgaatataaggaaaaatttaggcacaggaccatgatatagttagcacacagtgagtgtgat

SEQ ID NO: 374279 - DNA, 3497 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcact

SEQ ID NO: 374280 - DNA, 6388 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggtatgcagtactcattcttttttcccaagctcctgttttccctctgccttgctcctccctagccatttgctttaaggcccggagatgaattctaggcctttgaattctcttaactctcctgtagcatgaactgatacttcttttctctaaattcctagcctatatgatatgtactgcttgttttaatactcaacatcaatacattgccttaaagtgttatccagtacatacattttgttttctttaaagtacaagcttttgaaggcaaatgaccctgtttattattcctttgtattcttgtgtgccagcatgctgttgaacagatagataacttattcagcagattatttttcttttaactatttgaatggaactgttttcattgtatctataatgacgggcaatttttttcttaggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374281 - DNA, 4126 bp, Homo sapiens
aacatggtgtagtggaaagaacatggactttggtaccaaacacatcttaacacttaatatctgtgattttaggcaatttacttcacttacctgagccttagtttcttcatctttaaaattgagaacatactattaacttttaggattattgtgttgtgttttttgtttgttcgtttctggtttttagctattaactctccccactttagctccttaagggaagtgactgttttataaacaatattaatagcaacagaaacaacttatattgattgatcggttatgggccaggcactatatatctgaaaagtattgctaaatatatcccagaaaactgggggggacctaagaatttgggatcaattcttatgtttaacactgatttcttcattattatatgtgtcatacagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagccacttaaaacaaaagtttttttgtttgtttgtttgtttgtttttttgagatggagtctcactctgttgcccaggctggagtgcagtggcgtgatctcggcttactgcaacctccgcctcccgggttcaagcgattctcctgcctcagcctcccaagtaactgggacaacaggcgcgtcccaccacacccagctaattttttatacttttagtagagatggggtttcagcatattggccaggctggtctcgaactcctgaccttgtgatccacccgcctcggcctcccaaagtgctgggattataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374282 - DNA, 5314 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgaggaagattatgataaatatggaattcgaattagagtcaaatttcgaagtagtactcaactgcatgaattaactcctcatcatcaaagtggaggtgaaagaagtgtttctaccatgttatacttgatggcacttcaggagctaaatagatgtccattcagagtagttgatgaaatcaatcagggaatggacccaatcaatgaacggagagtgtttgaaatggttgtaaatactgcctgtaaagaaaatacatctcaatactttttcataacaccaaagctcctgcaaaatcttccttattctgaaaagatgacagttttgtttgtctacaatggccctcatatgctggaaccaaacacatggaatttaaaggctttccaaaggcggcggcgccgtattacattcactcaaccttcttaataaaagtaaagagagggaacttgggaattttttttgttaaattctgtttataagtatggctcaactgaataaaaggagattcactaaaacgaaaagcagttatttttggaaacctgcttttaaatacaaataggttgataatggaaactataatgacctttccaaaatagcagctggtagtaaaagttaagtcttcttcagtcttggttgaacttgagttcttggcactctgaccatgagtcattcagttctcatgttaaaatgtacttaatattacaaatcaaaggtacagtggaagaagggttaatcacaagaagttacttatatggtagccctgagctttaattgcagagtaactttaattacttttagagcctaaagatgactctagagcctaagtcctagtttctcccaatgttatatttaattttaaaaaattgatatgaaaatgtctaatgtatagtaataatttatgacagatctagtcatttcttcctattaaaaaagattaccttatctccagtaggaaatggaattttatgggcctttaaaagaaagttttatgaaacttgatgctataattttattggtatttcaaggggaaaaaagcactggggttcaaaaatggtagcagaactgctttgaaatgctgcaaggtggccactagatgatgcaaaatacaaccaaaagattgactgagaataaaattaggtgacaagggtttttaaagaataaccttttaaagtgtgggggcaggggttgcttttttttattttatttaaagtcaattatattttacatcttacatttctaaaagcattttataattatttttagtaagatttttcttaaaatttcatatactggtttctacaatttatatttgaaatttctcagtgttatgtaaagagtgatggaaaagcattgatttctttaaaaccgtaatgtttttagaacttaagcctatagggcctttcttacaatgttgatgtacccattatcttagaaaatctagtttaaactgttttctttcaccgcaaaagaattaaatgggaaaatcatttgtttatctctaagttatactaattagtagaaccaaacaaattatcttcttttaaaaaataaatcttataggaaaatagacagtccaaagtcatgtctttgaacagtggattggatctgtgccagtaatgacaaaattatttttttgacttgcttgcctgaataaattgaagaattgctttcagtttgggttttgtatattcttaagtagccattgaaatttatattcttaactaggtcaaaaaataatgagccataagtttatgtcctctcacttagacattttctctttaaaaaggtattttcttctttataaacattttaaaagagccttcccttcttaaactaactccagtgcatgaagtgtgaaaatattttaaaatgacatttttactaatatgagcaagtcatgtaaacattgaagaacttggtaacatattagtaaatggatattaccaaatgttttcatcgttaattactttgcgttccaccaaaatatctttactaaaatgtgcttggtgtagtttgtttattgtctaaattagtaccagtcatcttatttctgcaaaatgagtatcaatgtgaaaaagacacgtgaagattaagcatgtttgaaaataaaatggtcaattacatttcaatttacataggccaacaactgttccatactttgtttgtaaacatttaatttctctactggacaaaattaatatttggctttacattgaattttgagctgtgaagaataaattatgtatcattttagcatattaaacagtagtaagtctagcacatagtctcagcctgggcaacaagagtggaactctgtttaaaaaaaaa

SEQ ID NO: 374283 - DNA, 3849 bp, Homo sapiens
gcggcagttcgcgcgggagcggggcgcctgggtggatgggcgcttgggcgcctgggctgccggacggtgggaacggaagtcgctgtgggacgctgaggaagccaggatggcgactccgagcaagaagacgtcaactccaagcccccagccttccaagagagctctcccgagagacccttcgtcggaggtcccgagcaagaggaagaattcggccccgcagctgccgctgttgcagtcgtccgggcctttcgtggaaggctctatcgtccgcatctcgatggagaacttcctaacatatgatatttgtgaagtatctcctggaccccacttgaatatgatcgttggagccaatggaacagggaagtcgagcattgtgtgtgccatttgccttggtttagctggaaaacctgctttcatgggacgagcagataaggttgggttttttgtgaagagaggatgttctagaggcatggttgaaattgaattgttcagggcttctggaaatcttgtaatcacccgtgagattgatgtggcaaaaaatcagtccttttggttcatcaacaaaaaatctacaacccagaaaatagtggaagagaaagttgcagccttaaatattcaagtggggaatctttgccagtttctccctcaggacaaagttggagaatttgctaaactcagcaaaattgaactcctcgaagccactgaaaagtcaattggtcccccagaaatgcacaaatatcactgtgaactcaaaaacttaagggagaaagaaaaacagctcgagacctcatgcaaagagaaaactgagtatctacagaaaatggttcagaggaatgaaagatataaacaagatgtggagaggttctatgaacggaagcgacatttagatttaattgagatgcttgaagcaaaaaggccatgggtggaatatgaaaatgttcgtcaggaatatgaagaagtaaaactagttcgtgaccgagtgaaggaagaggtcagaaaacttaaagaagggcagattcctataacatgtcgaattgaagaaatggaaaacgagcgtcacaatttggaggctcgaatcaaagaaaaggcaacagatattaaggaggcatctcaaaaatgcaaacagaagcaagatgttatagaaaggaaagataaacatattgaggaacttcagcaggctttaatagtaaagcaaaatgaagagcttgaccgacagaggagaataggtaatacccgcaaaatgatagaggatttgcaaaatgaactaaagaccacggaaaactgcgagaatcttcagccccagattgatgccattacaaatgatctgagacggattcaggatgaaaaggcattatgtgaaggcgaaataattgataagcgaagagagagggaaactctagagaaggagaaaaagagtgtggacgatcatattgtacgttttgacaatcttatgaatcagaaggaagataagctaagacagagattccgtgacacgtatgatgctgttttatggctaagaaataacagagacaaatttaaacaaagagtctgtgagcccataatgctcacgatcaatatgaaagataataaaaatgccaaatatattgaaaatcatattccatcaaatgacttaagagcctttgtatttgaaagtcaagaagatatggaggttttcctcaaagaggttcgtgacaataaaaaattaagagtaaatgctgttattgctcccaagagttcatatgcagacaaagcaccttcaagatctttgaatgaacttaaacaatacggatttttctcttatttgagagaattatttgatgcacctgatcctgtaatgagttacctttgctgtcagtatcatattcatgaagttcctgtaggaactgaaaagaccagagaaagaattgaacgggtaatacaagaaacccgattaaaacagatttatacagcagaagaaaagtatgtggtgaaaacttctttttattcaaacaaagttatttctagtaacacatctctaaaagtagcgcagtttctcactgtcactgtggacctagagcagagaagacacttagaagaacagctaaaggaaattcatagaaaattgcaagcagtggattcagggttgattgccttacgtgaaacaagcaaacatctggagcacaaagacaatgaacttagacaaaagaagaaggagcttcttgagagaaaaaccaagaaaagacaactggaacaaaaaatcagttccaaactaggaagtttaaagctgatggaacaggatacttgcaatcttgaagaggaagagcgaaaagcaagtaccaaaatcaaagaaataaatgttcaaaaagcgaaacttgttaccgaattaacaaacctaataaagatttgtacttctttgcatatacaaaaagtagatttaattctccaaaatactacagtgatctctgagaagaacaaattagaatcagattatatggccgcatcttcacaactccgtcttacagagcaacatttcattgaattggatgaaaatagacagagattattgcagaaatgcaaggaacttatgaaaagagctaggcaagtatgtaacctgggtgcagagcagactcttcctcaagaataccagacacaagtacccaccattccaaatggacacaactcctcactccccatggtatgcagtactcattcttttttcccaagctcctgttttccctctgccttgctcctccctagccatttgctttaaggcccggagatgaattctaggcctttgaattctcttaactctcctgtagcatgaactgatacttcttttctctaaattcctagcctatatgatatgtactgcttgttttaatactcaacatcaatacattgccttaaagtgttatccagtacatacattttgttttctttaaagtacaagcttttgaaggcaaatgaccctgtttattattcctttgtattcttgtgtgccagcatgctgttgaacagatagataacttattcagcagattatttttcttttaactatttgaatggaactgttttcattgtatctataatgacgggcaatttttttcttaggttttccaagaccttccaaacacattggatgaaattgatgctttattaactgaagaaagatcaagagcttcctgcttcacgggactgaatcctacaattgttcaggaatatacaaaaagagaagaagaaatagaacagttaactgaggaactaaagggaaagaaagttgaactagatcaatacagggaaaacatttcacaggtaaaagaaaggtggcttaatcctttaaaagagctggtagaaaaaattaatgaaaaattcagcaatttttttagttccatgcagtgtgctggtgaagttgatctccatacagaaaatgagacaggcaaaggccaggtgctgtggcttatgcctaatcccacttttataggcgtgagcccctgcacccggccaaaagttgatttttaattacataaaaatcgtaaaaacttctagtaaaaacttgatttggtgaatacagttatattttaaaaccttaaggtgacaagcattttctatgcctaaatcttcattggtttgcctggaaagagtctctgttaaaagattttccatattcaaagtaaaaggaaagatttcttgctttctaattgtcttttggacacatgcctattttctttgaggtataaacctttagatgtgaaaaatgtaatttcattctgctattgtgtgtgcttgtgtgtgtgtaattgaaaaaactgggaaatcctgctttgttggtaataaatcaatatttttatattcttttggtgtatgttattt

SEQ ID NO: 374284 - DNA, 3224 bp, Homo sapiens
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaa

SEQ ID NO: 374285 - DNA, 1138 bp, Homo sapiens
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaa

SEQ ID NO: 374286 - DNA, 3293 bp, Homo sapiens
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaa

SEQ ID NO: 374287 - DNA, 1725 bp, Homo sapiens
  misc_feature (1402)..(1402): n is a, c, g, or t
  misc_feature (1408)..(1409): n is a, c, g, or t
  misc_feature (1487)..(1487): n is a, c, g, or t
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtaaaaaaaaaaaaaaaaaaaaaaaaaaaaaaaaaaaaaaaaaanaaaaannaaaaaaaaaaaccaactccaaaattaacctcaaacacaatcccataacaaaatattccttttacatttacactttccnttttattaaacccctttttataacaaaactttttgttaataccaatttattctcctatttaaaatctttatcttttctttacaaccacttttttaaccttaattcttcaatgacatattttttaccttaaatttaattaaattttttctttaaccatttattctctaaaccaatttctcaatcatatttataaacttttaatttcacctttttatcctccttttaatcttagtatcca

SEQ ID NO: 374288 - DNA, 3008 bp, Homo sapiens
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaa

SEQ ID NO: 374289 - DNA, 3005 bp, Homo sapiens
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaa

SEQ ID NO: 374290 - DNA, 1657 bp, Homo sapiens
  misc_feature (1402)..(1402): n is a, c, g, or t
  misc_feature (1408)..(1409): n is a, c, g, or t
gtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtaaaaaaaaaaaaaaaaaaaaaaaaaaaaaaaaaaaaaaaaaanaaaaannaaaaaaaaaaaaaaaaaaaaaaaaaaaaaaaaaaaaaaaaaaaaaaaaaaaaaaaaaaaaaatttcaggggggggcccggaaccaaattggccttatggggggtcgtttaaaaattaaagtggccggggttataaaaagttttgatggggaaaaccttggggttacccaattaaatccgttggggaaaaaatcccttttggccagttggcgtaatagcgaaagggcccctcccgatcgctctttccaa

SEQ ID NO: 374291 - DNA, 500 bp, Homo sapiens
ttaaggttacagtggaaagtgagagcacacagaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374292 - DNA, 837 bp, Homo sapiens
ttaaggttacagtggaaagtgagagcacacagaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaaaaaaaaaaaaaaaaaaaaaaaaaaaaaaaaaaaaaaaaaaaaaaaaggggggggggggcaaaaatttccccgggggggcccattttaagcgagcaccccgcgtgttcgtgtggaaacgaaagggggccccccatgaggagggacccgcctaataagaaagaccggagccgggggccgcggccttaaaaacaaaccgcgcgccaggaggacaacaaacgagtgcagtgagcaactcgtggagaaaaggacaccaacactcggcggcggggaacaccaactgggaaccacactccctgacgaattaaggcccgagggaaaataacctgagggctacagg

SEQ ID NO: 374293 - DNA, 949 bp, Homo sapiens
ttcactctgtctcaaagaaaaaaaaaaaaaaaaaaaccttctgagaggttttaatgtgctagatacaaaatcaatatactgaaagtcaaacatgtttctctacactagcaacagaaacataatttttaaaaatactacttattagagcagaaaatataaagtacttaggaataagtctaacaaaagagtgtaagacacttctggagaaaactataaaactttgttaaaaggcattaaataaaaactgaatagatagaatgatttatctagtacacagatggaacgatcttctgtgaaggtgtaaattcccaccaggatatataccgttaatgcagttccagtcaagtgctcagcaggtatatgtgtgtgtttctttttgcaatgagataagctgattccaaaactgatttggaagaaaaaaattcaaaaaaagctgagacaatgttgaagatcataatggggccagggagggactcgccctaccaggttctataaaatcatagtaaacaagtccatttggcacaaagaagacagagccctggaacgaaagagagctcagacccatgtgaatgtgtggaaccttgacaaatgacaggtgacctgaaaagccatttggaaaggatttcatcagtgagtgatactctcacatttgatgacctagactgattatgtattaggaaatctggcctaatctttcattttgtttctcattttagatgtcatagtctggcttataatgcttatgtaaaattcagcaccttgtttttattttgtaagatgctgggcacaaatcatggctttgtttttttctcctgtagggtgaaattgatgcccatgaagacagcttcaaatctgcagatgaatctggacaggcactgcttgctgctggtcactatgcctcagatgaagtgagggagaaggtaagagaagagaaaccgtcgcattcgag

SEQ ID NO: 374294 - DNA, 7861 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374295 - DNA, 8047 bp, Homo sapiens
  misc_feature (7828)..(7828): n is a, c, g, or t
  misc_feature (7830)..(7830): n is a, c, g, or t
  misc_feature (7837)..(7837): n is a, c, g, or t
  misc_feature (7843)..(7843): n is a, c, g, or t
  misc_feature (7845)..(7845): n is a, c, g, or t
  misc_feature (7852)..(7852): n is a, c, g, or t
  misc_feature (7856)..(7856): n is a, c, g, or t
  misc_feature (7863)..(7863): n is a, c, g, or t
  misc_feature (7867)..(7867): n is a, c, g, or t
  misc_feature (7966)..(7966): n is a, c, g, or t
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgtttctgntnagacatnatgtgnantcccccnaaanaaaaagngggncgcaaaatcccggggccacatacggaccactatgtcaaagcgcaccagaggcgaaaaagacaggcgcataaaccactgggacaccaccgcaagagaacnacaccgaaaatggaacacagcaacactaaaacagtgcgacacgcgactgacagagatacacagaggcatgaatcgtagcat

SEQ ID NO: 374296 - DNA, 7878 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374297 - DNA, 7344 bp, Homo sapiens
ttcactctgtctcaaagaaaaaaaaaaaaaaaaaaaccttctgagaggttttaatgtgctagatacaaaatcaatatactgaaagtcaaacatgtttctctacactagcaacagaaacataatttttaaaaatactacttattagagcagaaaatataaagtacttaggaataagtctaacaaaagagtgtaagacacttctggagaaaactataaaactttgttaaaaggcattaaataaaaactgaatagatagaatgatttatctagtacacagatggaacgatcttctgtgaaggtgtaaattcccaccaggatatataccgttaatgcagttccagtcaagtgctcagcaggtatatgtgtgtgtttctttttgcaatgagataagctgattccaaaactgatttggaagaaaaaaattcaaaaaaagctgagacaatgttgaagatcataatggggccagggagggactcgccctaccaggttctataaaatcatagtaaacaagtccatttggcacaaagaagacagagccctggaacgaaagagagctcagacccatgtgaatgtgtggaaccttgacaaatgacaggtgacctgaaaagccatttggaaaggatttcatcagtgagtgatactctcacatttgatgacctagactgattatgtattaggaaatctggcctaatctttcattttgtttctcattttagatgtcatagtctggcttataatgcttatgtaaaattcagcaccttgtttttattttgtaagatgctgggcacaaatcatggctttgtttttttctcctgtagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374298 - DNA, 6488 bp, Homo sapiens
  misc_feature (14)..(14): n is a, c, g, or t
gtcggtaccctganctcttccgtccggcaatggtcactatgcctcagatgaattgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374299 - DNA, 7669 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374300 - DNA, 6212 bp, Homo sapiens
atccgcccgccttggcctcccagagtgctgggattacaggcgtgagccaccacgcctggccttggtttgtattcttaccagtagtctgggtcataaatataagaggaaaaagatcaaatacgtggctaaattgcctgttagcactcagtaaaatttctttctaagggtagtccagtctgttccctgaccttgctctgtgaagttaccagtgttttcagcacaggaaaatctgccttaagcatggcagacccgccaggaaaatgaaggtgaactaaccctctaattttcctgctatttctttactgtcatgtcactcatgacttagactgctccttagacctgttgaataactccatagtttcccaacattaagcatccaccatcatggcaccagtcggagctgctgcctttcatccctgtggattaaccccactaattcgtgcatgcttttgctgtgccccctctgtgcaggacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaacatcctatatgaggatattttaaagctcagtgtaccctcccccacctcaccccagcctgggggctcttcagagaattataaaagacagaaaaaccctctgtatacattctgcccagcaagttcatctcgtctctccactgtagttgcatgagccctgtgttactgtgctaagcgcttggtttcagtcccttgtggttgtgttgttctaagtgcagaatcggcctggggataagtgtgcctggctgttctagccacctggttgtgaacagtacagtgtgcgcatatctctcaggctgtggcgtgggtacttgggatcctcgtcttcatctgataactctgttactagggcatcatcattacaaactcgtagcctggaatccacatcttggagacacctcgtggtttgcctttatgttagcatctacagctaactgccttccttgtccctcttgtcaccctcttgaattccatcagatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374301 - DNA, 7822 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgttctctctcccaccctcccccaaatctgttttcatgtaaaagacaaataaatgatgacttcccccaaa

SEQ ID NO: 374302 - DNA, 3989 bp, Homo sapiens
tctcttgggacgcaggttgttggtgtgaccacacttcttcttgcggcagttgacagcacgagggtgaaggcgagcatagcacttgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374303 - DNA, 7950 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacaggtaaattaattaaggccaggtgctgtgagcctctgcccggggcacccacctgccctccctgctcaggctcttgcttcccccgctcctagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374304 - DNA, 8047 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagatgagagacccggagaaatcctggttacactgcttgaatcctacacatactaacaaaaggccacatgaggacacagtgagaagctggaagtctacaacccagaagagagccctcaacagaacctaaccatgctggtaccctgatctcagacatccagcctccagaagagtgaaaaaatataattcttatttctaagca

SEQ ID NO: 374305 - DNA, 2007 bp, Homo sapiens
tgggtagtagtaatagcaactgaactagaagacgggctgcagggagctcgtcatggcacagatggaggccaggcctgggtgcagggaggggcctgctaatgtgggttctgaggctgtagttaggaagattgggatttatctgtacacaaaaaatggtttgtctgggttttgatgtttttcctttctaatccatctccactgaggagggcagtatattttccacacttcgttttctaggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374306 - DNA, 1752 bp, Homo sapiens
ggcatgccaacatcactgccttcctgctggaaggcctgcagcccagcgtcaaaagtttccggttcggtgaggagcgtctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374307 - DNA, 7643 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagtcaaatttgtggcagagctgagtctggggtaacaggccctgcgctgggtattctccccatttacaaatcaaactcagtatgggacagaagtcccggatctgcttgtagaagcagctccgagcccccagcatcctgagacctgggaggtcgggtttgaagtgggtgcagctggctcaggcaccaggtg

SEQ ID NO: 374308 - DNA, 1525 bp, Homo sapiens
  misc_feature (42)..(42): n is a, c, g, or t
caacggggggggaaccaaaacttcggctaaggtacgaggccngtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374309 - DNA, 7246 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagcaaggatgtgtttgtctgatttcccgttacagccccagcacttagctgagtgactggcacctagtaagcactcagtaactgtttgctgaataaatggaagaatggtcaaaaggct

SEQ ID NO: 374310 - DNA, 1193 bp, Homo sapiens
agggtaaaacgacggccggggagccgcgaatcttgctcttggttgtttcctgagggaaaacgcccgccaggggatccccaatcagggccggggcttgtaccagggggtaaaagagacccggacatacctcctagatgggtcctggctggtgccagaggcgaaaaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374311 - DNA, 6333 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggcagtgtaggcccagtccgaaagttgtatgacgacgtgcagtcagaagctggcaagctcgcag

SEQ ID NO: 374312 - DNA, 6211 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctggcctacagcacatgccggtaccggctc

SEQ ID NO: 374313 - DNA, 844 bp, Homo sapiens
atgtacacagagcagagcatgtaagcacacagggagaagacagccatccacaagccaaggagagaggcctcagcagaaaccagcctgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374314 - DNA, 5765 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctgtaagagaacctggacagtcagcagtttgtaatcgtcatagcagagtgtctgca

SEQ ID NO: 374315 - DNA, 5496 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaacatcctatatgaggatattttaaagctcagtgtaccctcccccacctcaccccagcctgggggctcttcagagaattataaaagacagaaaaaccctctgtatacattctgcccagcaagttcatctcgtctctccactgtagttgcatgagccctgtgttactgtgctaagcgcttggtttcagtcccttgtggttgtgttgttctaagtgcagaatcggcctggggataagtgtgcctggctgttctagccacctggttgtgaacagtacagtgtgcgcatatctctcaggctgtggcgtgggtacttgggatcctcgtcttcatctgataactctgttactagggcatcatcattacaaactcgtagcctggaatccacatcttggagacacctcgtggtttgcctttatgttagcatctacagctaactgccttccttgtccctcttgtcaccctcttgaattccatcagatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggtaagtttcgggtgctgtgtgtggatcttgaacatgagaaggacttaaatcttgggaagaatatcaagccaagaacttcttcatcagaattgctgttcctgaacctcagatgccttttgtgtgtaaagatttgtggaaaactccaaaaattgatttctttttttttgagacggagtctcactctgtcaaccaggctggagtgcagtggtgtgatcttggctcactgcaacctccacctcccaggttcaagcgattctcccatctcagcttcctgagtagctggaattccacgcatgtggcaccacacccagctaatttttgtatttttagtagagatggggtttcaccatgttgtccaggctggtctcgaactcccaacctcaggtgatctgcccacctcagcttcccagagtgctgggattacagacgtgagccaccacgcccagcccagaaattgatttctatttgccattctccaaaagacaaaaaaagttggttttttttttttttcggtcttttgtttgtttgtttgttttttaagagatagggtcttgctttgttgcccagactggaggtcagtggcttttcacagctgcagttatagcctactgcagcctcgaactcttggcctcaagcaatcctcccacctcagcctcccaggtatctaggacaacaggcatgcaacacaaagcacagctctaaaaaaa

SEQ ID NO: 374316 - DNA, 3673 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagccaacagccaacagccatttaggtaacagccatttaggtaacagccattatagg

SEQ ID NO: 374317 - DNA, 3580 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggtttaacacaggagaaaaagtaagaaacaatgaggacgtcggagcggacggggcccagcaggcggcgctccgaaagaaggttgataagctaccatgaagaacgtcgaagcaaccagtgagctcacgggcgatagcgagcacaatcagga

SEQ ID NO: 374318 - DNA, 3359 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattgaactttctacacaattgtctaccacagaacctctaaaatattcgtttcactgtacaactcaaaggccttaaaaattgacaccatgaaagattggattcactgtaaagactgatatattgttttagttttattatgtttactttaaaatgtgatctcaaggtgtagaaattgaa

SEQ ID NO: 374319 - DNA, 2866 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggtggtcccgggttacccgggacctcctttgtttgcagcctaaattctcatcacctggtggtcccaaatacttgaaagtatagatttaatttgaagtggtttcagaccagggatgcctgctatgtgcctgacaaaagcaaatgcatccctctctggaggaggcctcttaggcctcaaagaatacccagagggaatttttcaacgatgacaagctc

SEQ ID NO: 374320 - DNA, 1742 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagtaagaccccttcttgtcagtgctttcaaatgacccttatagtaagccagagtctt

SEQ ID NO: 374321 - DNA, 970 bp, Homo sapiens
ggccgcattcggaccggtccctacaaacaagggggtgattagtatgttgggacaaacacgctgttgctaaatggaaacactgacctcacagtgcatcctcctgccaacacacacacacacacacctctcacacatgcacgcttacacacacacacacacacacacacacacacacacatacacacacacacacacacgctctctctctctctctctctctctctctgtcagtgtgttatcggtgtggagcggaggccgcggaggctcctcggtccttcagcacccctcggcccgacgcacccacgcccctcaccccccgagagccggtgagaggggcagccggggagctccgggagggagcggggccccgggcagccgacccccgggtgggagctgggcagctcttcaggcggggcggggccggcgcgcggacaggtgagccgggcgggccgcggggctgcctccattcggctgagtgggggaagccgctgccgctgcttttgtggcgcgtgggctgcggaggagcagccgggccgaggctcggcgccgccgctggaatgtcactgacggggggagggggcgcgaggccgccgggtccctcccaaccacccccaagcctggctgcggcgcggccctgccctgccccatccggctgcggcaggtgggtgggggctccctcgtcgggatcttcgccagccgcctccctgcagaacgctccccgcaccgcccccggtcccttccctcggccgggagcgacttctgcagctcgttcttccgaatcgcaccagcaatgccggccagccgtagagggaggaagagcccggggagcccgagcatagcgtaaacggctctctgaccttaatttcatcctgcatggcgaatctctgccgtctctctgaacgcagaagggtctgagactggccgtctccttttctttccttgtaataaacatttttctttcttcctaaaa

SEQ ID NO: 374322 - DNA, 656 bp, Homo sapiens
atccgcccgccttggcctcccagagtgctgggattacaggcgtgagccaccacgcctggccttggtttgtattcttaccagtagtctgggtcataaatataagaggaaaaagatcaaatacgtggctaaattgcctgttagcactcagtaaaatttctttctaagggtagtccagtctgttccctgaccttgctgggttcaagtgattctcctgcctcagcctcccaagtagctgggactacaggtgcgtgccaccatgcccggctaatttttgtatttttagtagagacggggtttcaccatgttggccaggctggtcttaaactcctgacctcaggtgatccacctgccttggcctcccaaagtgctgggattacaggtgtgagccaccgctcccagccccaatatttcctcttaaagagctcagaatctagtgctgggtgggggtgggctactgaggtgggccagaagagaagggacagtgcttcagctccctctgaccctcaccactctaggagcaccagaaggtggagctgctgcggaaggccgtgcaggcccaccgaggctacaccgaccgggtaagtgagcccgcttgtgcctactcacttgtcccttagtgtcagccatctgtctgtccctctgactgtccgtcccga

SEQ ID NO: 374323 - DNA, 217 bp, Homo sapiens
ttgcagtgagctgagattgtgcattgtgctccagcctgggtgacaagaatgaaactccatctcagtaaataaataaataaataaataaataaattttttttagtgtcctgtaatcaaggcagttgtacttggcatttcttaacctgaatgtgtctcgcctttagagatgctgatgaaaccaaagaatggattgaagagaagaatcaagctctaaaca

SEQ ID NO: 374324 - DNA, 650 bp, Homo sapiens
gtaagtttgtaggttcttcatgctcctcctttttggtacatgaatgtctcttctaagatgttccagttaagtctcttcaactggatatccctttgggagtgaacactagagactcacaggggatccttgtctttcagctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagtaatgtactgttagtgttgccatgtagcactcgattagtaagctaaacacagctctcacaaataaattgtagctaaaggacgaaataagggattccagaaaccccactacttaatgtaagccaactgttttatacattcctccataaagataagtatgaaggtagtgcaagggaacttgacgttctcaggttcaagatagaaagaacccccttcttttattcacaggatccatccaacctacaaggaaaagtacagaagcatcaggcttttgaggctgagctctcagcaaaccagagccgaattgatgccttggagaaagctggccaaaagctgattgatgtcaaccactatgcca

SEQ ID NO: 374325 - DNA, 151 bp, Homo sapiens
ggtgctttgtttcatggtcaattgcttggctgcctaaattcctctttctttgaataggatgaaactgattccaagacagcctccccgtggaaggtaagaactcctttgcaaattattgttttcaagagttttgcgagatcatgaaatatgt

SEQ ID NO: 374326 - DNA, 370 bp, Homo sapiens
cccatggtcccagctattcgggaggctgaggtaggagaattgcttgagccgaagaggttgaggctgcagtgagctgagattacgccactgcactccagcctgggcaactgagcaagaccctgtctcaaaaaaaaggacttccagttcatctactcctgagctagtacatttccttcctcctttgctaactccccaagagatgaaccctaaaatatttcatacaaactccaattgccttctgttaaaaacgttggcatttaccccagttctttatgtttgctgccactccctgcctctgagaaccccttccccctgaaaagacataacctagcaggaactggtttggaaaaaatttttttggtatttttag

SEQ ID NO: 374327 - DNA, 586 bp, Homo sapiens
ggccgcattcggaccggtccctacaaacaagggggtgattagtatgttgggacaaacacgctgttgctaaatggaaacactgacctcacagtgcatcctcctgccaacacacacacacacacacctctcacacatgcacgcttacacacacacacacacacacacacacacacacacatacacacacacacacacacgctctctctctctctctctctctctctctgtcagtgtgttatcggtgtggagcggaggccgcggaggctcctcggtccttcagcacccctcggcccgacgcacccacgcccctcaccccccgagagccgaacgctccccgcaccgcccccggtcccttccctcggccgggagcgacttctgcagctcgttcttccgaatcgcaccagcaatgccggccagccgtagagggaggaagagcccggggagcccgagcatagcgtaaacggctctctgaccttaatttcatcctgcatggcgaatctctgccgtctctctgaacgcagaagggtctgagactggccgtctccttttctttccttgtaataaacatttttctttcttcctaaaa

SEQ ID NO: 374328 - DNA, 8198 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaaaaaaaaaaaaaaaaaaaaaaaaaaaaaaaaaaaaaaaaaaaaaaaaggggggggggggcaaaaatttccccgggggggcccattttaagcgagcaccccgcgtgttcgtgtggaaacgaaagggggccccccatgaggagggacccgcctaataagaaagaccggagccgggggccgcggccttaaaaacaaaccgcgcgccaggaggacaacaaacgagtgcagtgagcaactcgtggagaaaaggacaccaacactcggcggcggggaacaccaactgggaaccacactccctgacgaattaaggcccgagggaaaataacctgagggctacagg

SEQ ID NO: 374329 - DNA, 7321 bp, Homo sapiens
ctggttgtcaggtctgggaagaccttcacttgcactgctgctaccccgagtcaagacccgctaacgccaccctctcaaaatccggaaacacattccggcccgaggtccacctgctgccgccgccgtcggtaggagctggccctgaacgagctggtgacgctgacgtgcctggcacgcggcttcggccccaaggacgtgctggttcgctggctgcaggggtcacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374330 - DNA, 7801 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374331 - DNA, 9010 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactgtgagtaggctgagagtcttgcagagcaccaatgtccactgctaccctatccattctccctctgccgcttctcttgaaggcctttgtccatccagaaagatgaggtggtgggaggaactgcctgtccgtgcagcagctttggctcacaagggaagaggtcgcggtgcagctgtgtcggtcgatgactgcttatctcattggttgcttccatgtgcagctgtgtgttcagagtggtgttggttctccctcctgttggtttttgtggtggaccagccactatcagcagcaaacctgaaggcctgttctatagttttccttagtaggaaggaaatcatatgcttctcttaaagtgctctgattcttggtaactcattgcttttttattttactttgggacacttagatttgatgatgattctagttttttttaatttttagttttttattgtttgttgttttcgtgttcaaagataatatttcagccttttgtattttagttcccgagggttagaatattctttgattcttaagaaatctttcaagtaacagaatggcacagatactcagtactgtgcctgattttccttctgaacttgccaaaactttctgagagctgaatgtatcattttagaaatgtcctactaatatggagataaaacatcctatatgaggatattttaaagctcagtgtaccctcccccacctcaccccagcctgggggctcttcagagaattataaaagacagaaaaaccctctgtatacattctgcccagcaagttcatctcgtctctccactgtagttgcatgagccctgtgttactgtgctaagcgcttggtttcagtcccttgtggttgtgttgttctaagtgcagaatcggcctggggataagtgtgcctggctgttctagccacctggttgtgaacagtacagtgtgcgcatatctctcaggctgtggcgtgggtacttgggatcctcgtcttcatctgataactctgttactagggcatcatcattacaaactcgtagcctggaatccacatcttggagacacctcgtggtttgcctttatgttagcatctacagctaactgccttccttgtccctcttgtcaccctcttgaattccatcagatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374332 - DNA, 4946 bp, Homo sapiens
gtgcaccttgcatgctgcggtcgctctaaggcctccccggcttactggaccttcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374333 - DNA, 4181 bp, Homo sapiens
taggctagtagaggcgggtgtgaatcggccgagggctagctgaatgaatccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374334 - DNA, 3712 bp, Homo sapiens
  misc_feature (272)..(272): n is a, c, g, or t
taggctagtagaggcgggtgtgaatcggccgagggctagctgaatgaatccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcggnaaagaggagatccagcagcggctgcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctggagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374335 - DNA, 3531 bp, Homo sapiens
ccatctccactgaggagggcagtatattttccacacttcgttttctaggtgaaaaggagaacagcttgaagacagatgattatggccgagacctgtcttctgtgcagacgctcctcaccaaacaggtctgccctggccccttcactggttgaaatgtatgcagatagcatctgtgagatgactggtggcgtctttcgctgaggtaggagaattgcttgagccgaagaggttgaggctgcagtgagctgagattacgccactgcactccagcctgggcaactgagcaagaccctgtctcaaaaaaaaggacttccagttcatctactcctgagctagtacatttccttcctcctttgctaactccccaagagatgaaccctaaaatatttcatacaaactccaattgccttctgttaaaaacgttggcatttaccccagttctttatgtttgctgccactccctgcctctgagaaccccttccccctgaaaagacataacctagcaggaactggtttggaaaaaatttttttggtatttttagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374336 - DNA, 3075 bp, Homo sapiens
gtcactgtcaacctgatataataacttggacatacagtcttaagacactaaatggattatagaagactttaggctgaattacagatggggaatgctagtgagaatggctcctatgagtgttttccattctcttctcttagaagttctcaaattgagctttaggagagggacgattcttcatagatttcatctctttttggctcccttctgttccccaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374337 - DNA, 2646 bp, Homo sapiens
tacttttcacaggggggaagagggttgttatggtttcggacgacccttgctctgaccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374338 - DNA, 2672 bp, Homo sapiens
gatgaaaggcgatcatcatgggcagatatatctgcttcagcagttgatgctttttcagcaggttgttcacagaagccaggtcttgccataatcttcggatgccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374339 - DNA, 7594 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtgtccggccacgttgccggacacgtaccagtactcttcccaatgctccttaatatgctgattttctttactattgatccccagtgtcttaatatgtgaactcagcagtttaaggttgcatttttccaaacttcag

SEQ ID NO: 374340 - DNA, 1644 bp, Homo sapiens
  misc_feature (135)..(135): n is a, c, g, or t
  misc_feature (142)..(142): n is a, c, g, or t
  misc_feature (157)..(157): n is a, c, g, or t
caacgatggtcctcagctcaacgatggtcctcagctcaacgatggtcctcagctcaacgatggtcctcagctcaacgatggtcctcagctcaacgatggtcctcagctcaacgatggtcctcagctcaacgatgntcctcanctagagtcacttccncaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374341 - DNA, 1859 bp, Homo sapiens
gccaacatggggaaaccccatctctactaaaaatacaaaatattagctgggtgtggtggcaggcacctgtaatcccagctactcaggaggctgaggcaggagaatcacttgattctgggatgcggaggttgcagtgacccgagatcaggccattgcactccagcctgggtgacaagagcaaaactccctctgaaaaaaattacttgggcatggtggcctacacctgctcaaagtccagcatgggcaatatatagcaagaccttgtcttaaaaataaggctgggtgcagtggctcatgcctataatcccagaactttgggaggccaagacaggcagatcacttgagcctaggaattcaagaccagcctggtcaatgcagtgaaacatcgcctctactaaaaatacaaaaattaggcaggtgtggtgatgggcacctgttagttccagctactcaggagattgaggcaggagaatcacttgaacccgggaggttgcagtgagcgtgattgcgccactgcactctagcctaggcgacagtgagactccatctcaaaaaaatttataaaaatctttggccactgcttcctggagtcctcgccgtacttgtccttggcgtgcactgccctctggcaggtctaccagctgctttggaaccctcacattgaaagtctctccctctattgaggtggttgggatttcttcagcttcaccccatcccactattcctattctagaatgttcttgttttacggggtctcaggccaggcctggagcaggaaccagagggcagtaagtggctcctgggctggtgactgagctgagggcccccgtctgagcatctgtgctccccacccctgcagcgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374342 - DNA, 6637 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccctgagttaacagctcgcccctgagttagcagctcgcccctgagttagcagctcgcccctgagttagcagctcgccctgagttagtgcgggtac

SEQ ID NO: 374343 - DNA, 1021 bp, Homo sapiens
ttaagagatactaaagggggttagacctcggcgacatgatctattaagtcaatcgaattttacaaccctgagccacttaggcaacgtactttaggtttcacataattttcacagtcttagtaccaccattttcattcagataaaagaaatgaccttttgaaatcatgggcatcacatttggtgcttatggacaagaatcacaactagaagctagagacaaaatggatcacagcaagcacagtttccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 374344 - DNA, 6322 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaactggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgagcactgtcagcaaggcccggaagagccttcccagagctgctctttgtctccttccgtgtcattggttttcttctgcagagaagaaactgatcaattgtgggcatggcagagaacctactaccagggcagaccactgactgccagctaggaggagacagtgtcctgaggccagaactgccacccggaactgggctggcaccagggtcaataaacaaaagcctgtaaac

SEQ ID NO: 374345 - DNA, 5132 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggctttccaagctgctgggtgttggtcttgatgtagccttatgttattgagtagattttgttaaataaagcatttataaaacaatctccttgcacccatgggaagtcagtgagaaatatttcagtaagcccagccagtgggaaagccctagtcaagtttcagagccatttaaaagttgccttcctcatttgtctccattaaaactatttctgctgtaataaaagtctatagaatcccccttctattactgttcccaaatgc

SEQ ID NO: 374346 - DNA, 3796 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtcttatggcagaggaggtgcaggctgtgcaacaacaggaagtgtatggcatgatgcccagggatgaaactgattccaagacagcctccccgtggaaggagctgaatgagcgctggcggtccctacagcagctggccgaggaacggagccagctcttgggcagcgcccatgaagtacagaggttccacagagatgctatgaaacccgagaggggattgaaaagcaggaccatagctcaacaccgagcagagccaagacagg

SEQ ID NO: 374347 - DNA, 3404 bp, Homo sapiens
  misc_feature (3292)..(3292): n is a, c, g, or t
  misc_feature (3333)..(3333): n is a, c, g, or t
  misc_feature (3354)..(3354): n is a, c, g, or t
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagaaagacgttctattacataaangactttttttaacactttggacttctctgaaatatttagangtgctaatttcttgcccaccnccaacaggaattctatagtaaggaggaggagaaggggggctcccttccct

SEQ ID NO: 374348 - DNA, 3140 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgccctgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggcaccagcacgaattccctt

SEQ ID NO: 374349 - DNA, 1262 bp, Homo sapiens
cgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcgttggatgcagtccgagaaactgcacctgtaaattctgcagtcactttaaattataaaacgagtatttgatgtatgatcgcggcgttggatgtagt

SEQ ID NO: 374350 - DNA, 833 bp, Homo sapiens
tgagatatacaaatactattttaattctaaaaggagcaaaaattttaaaagctgataacaatttaaatcagttgcagatctcactttttcaagaaatgaaaaaaccaaagcattgttatattaaatctttttaacagctatgaaagcacagaacaaaattggtcatttaacatgtgtaattattatatatttatattcttagctctagtgctattttgagaacaagcattattttcctctcaattcaacgaatatttcttcctcactaatgttataaaagatgctaatgtgaggattttggatttggactgcagatcacatctcttttacagtttgaatccattcagaattaatggtccagttgtcaagaaaacatttctatttcaatttcagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtggaggtagttcagatttttttcagtaggcattagggggtttttggaagggaggaatataaaggatgttgtgctttaagatgattaatctgccagccatgtatacaatagactggaatgcagagagtggagatggagaggctgggtaagaggctgtcaagtttggcaaggagaagtaacataggcccatactgcaggtggcta

SEQ ID NO: 374351 - DNA, 415 bp, Homo sapiens
ccggcttcgctgtgctttccccgaggcgtctcgaagccgggggccaggaccggtcctggcccccggcttcgctgtgctttccccgaggcgtctcgatcgcctagctgctgcgctctttacccttgtttttttctgtcgattctgaggtggtgttttttggtgtctgtttttgccctgtggccttagggtgcccttcctgtcccttctttcagaaacagtcattctgtaataatagctaaataaagttaatgctgtacaactaacgtcttgtttcttgatggtcagtttgtatggaatgcacctgcaagggtacctccttgtctgaaagtcgtgctttaaaaataattaattaagagagagagagagaaagatggcccataaggaaaactctgaatgtctcctgtattaaggtgaa

SEQ ID NO: 374352 - DNA, 1975 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374353 - DNA, 2128 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374354 - DNA, 2197 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374355 - DNA, 1985 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374356 - DNA, 1882 bp, Homo sapiens
actcctgagggtaaaacaaggtaagcgaaccggagtcatggcgaaggctgattcctgatataaaaacccatgcaacgaaatctgcacagtgatttggcaaagtacctggaggaaaaagaagttgaaaggccacaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374357 - DNA, 2089 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374358 - DNA, 1669 bp, Homo sapiens
ctcggctctaccttgtctcctgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374359 - DNA, 2432 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaagaaaggaatgtgaatgagtcacttaacagggaatctaaagagctgtgttagctgtgtacatacacagattatctgagaaaaggtcaagggttccacttgggccacagtttttttgttaatcaaacaccactctcttaagaggctgcatcacaaaaggcaacaaagggcccctctaaggcttgagattaaaactagtctttatcattactgctgtgacactcttgccttagtatattaagagactcatacatttttgatatcacaa

SEQ ID NO: 374360 - DNA, 2165 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatcc

SEQ ID NO: 374361 - DNA, 1222 bp, Homo sapiens
ttagcacgaggtattccaataactgtaccacctccaggtttgcctcctccaccaggcgctccacctccatctcttataccaacaatagaaagtggacatcctctggttatgatagtcgtctgcacgtgcatttccatatggcaatggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374362 - DNA, 869 bp, Homo sapiens
gcaactttgtttcactcttgacattaagtgtacattgttaacattttttatcttatgattgaatgtttcaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374363 - DNA, 598 bp, Homo sapiens
aatcctttccccggcagcacatctctactcctgcctgtgccttagtgagtccttttggtggcaggcagatatattatgccatagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374364 - DNA, 866 bp, Homo sapiens
tgagatatacaaatactattttaattctaaaaggagcaaaaattttaaaagctgataacaatttaaatcagttgcagatctcactttttcaagaaatgaaaaaaccaaagcattgttatattaaatctttttaacagctatgaaagcacagaacaaaattggtcatttaacatgtgtaattattatatatttatattcttagctctagtgctattttgagaacaagcattattttcctctcaattcaacgaatatttcttcctcactaatgttataaaagatgctaatgtgaggattttggatttggactgcagatcacatctcttttacagtttgaatccattcagaattaatggtccagttgtcaagaaaacatttctatttcaatttcagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374365 - DNA, 615 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaatttttaaagtcactaacaaccaaacaaaaacagaaacttctcaggaaattagatcgactggagaagaaaaaaaagaaaaaagatagaaaaaagaaaaagtttcagaagagcagaagtaaacacaaaaaacataagtcctcttcttcctcatcttcctcctcctcctcctcttcctctactgagacttcagaaagcagtagtgagagtgagagtaacaataaagaaaaaaaaatacaaaggaaa

SEQ ID NO: 374366 - DNA, 309 bp, Homo sapiens
agaaagacgacacagggagaaagaggaaaccagacataagtcttctcgaaggtttgctctttaataaaatagtgaaccaatagtatgtgagagattttgacttactacattgtcgcattggaagaggggaaattttggcctatgaaccagtcttgcttggtttcattaaagaaaaattcagggccttgtctcaaatttttttaaaaaagcattaaacaaaatacctattgtttgccaaaaatcaaccctatacagtatttccggttttgagttaatgcctgtttctaatttgttactgtatattataat

SEQ ID NO: 374367 - DNA, 2155 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggtattccaataactgtaccacctccaggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374368 - DNA, 1552 bp, Homo sapiens
tcacgtctagatgccagactctggatgcctgcaacgtgggtataccagagtacgtcgtatccaccacgtggtgactgtgcgcatcacacacaggcgctccacctccatctcttataccaacaatagaaagtggacatcctctggttatgatagtcgtctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaaaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374369 - DNA, 2243 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactctatctcttttataaaaataccagagaggttgcgtgcactttagatattttaatagtcgtatcttttataaaggtatcagggtttttgtcgtggtacaggaagataatgtgcttt

SEQ ID NO: 374370 - DNA, 1914 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374371 - DNA, 1875 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggccgaagactgtactatggaagttacaccaggtgcagagatccaagatggcagattcaatctttttaaggtacagcagggaagaactggaaactcagagaaagaaactgcccttccatctacaaaagctgagtttacttctcctccttctttgttcaagactgggcttccaccgagcaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtact

SEQ ID NO: 374372 - DNA, 2085 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggcccatgggacgtgcatgtgcacagtgatttggcaaaggacctagatgaaaatgaagttgaaaggccagaagaagaaaatgccagtgctaatcctccatctggaattgaagatgaaactgctgaaaatggtgtaccaaaaccgaaagtgactgagaccgaagatgatagtgatagtgacagcgatgatgatgaagatgatgttcatgtcactataggagacattaaaacgggagcaccacagtatgggagttatggtacagcacctgtaaatcttaacatcaagacagggggaagagtttatggaactacagggacaaaagtcaaaggagtagaccttgatgcacctggaagcattaatggagttccactcttagaggtagatttggattcttttgaagataaaccatggcgtaaacctggtgctgatctttctgattattttaattatgggtttaatgaagatacctggaaagcttactgtgaaaaacaaaagaggatacgaatgggacttgaagttataccagtaacctctactacaaataaaattacggtacagcagggaagaactggaaactcagagaaagaaactgcccttccatctacaaaagctgagtttacttctcctccttctttgttcaagactgggcttccaccgagcagaaacagcacttcttctcagtctcagacaagtactgcctccagaaaagccaattcaagcgttgggaagtggcaggatcgatatgggagggccgaatcacctgatctaaggagattacctggggcaattgatgttatcggtcagactataactatcagccgagtagaaggcaggcgacgggcaaatgagaacagcaacatacaggtcctttctgaaagatctgctactgaagtagacaacaattttagcaaaccacctccgtttttccctccaggagctcctcccactcaccttccacctcctccatttcttccacctcctccgactgtcagcactgctccacctctgattccaccaccgggttttcctcctccaccaggcgctccacctccatctcttataccaacaatagaaagtggacattcctctggttatgatagtcgttctgcacgtgcatttccatatggcaatgttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttctgtttgttagtatgaaaagttaactttttttccaaaataaaagagtgaatttttcatgttaagttaaaaatctttgtcttgtact

SEQ ID NO: 374373 - DNA, 920 bp, Homo sapiens
taggctaggtacgaggctgggtgttgaatcggccgagggacggacctgcgctggaggcttcatctttgccgccgctgccgtcgccttcctgggattggagtctcgagctttcttcgttcgttcgccggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggtacgaaacttcctgtctctgtctctcgggttctctcaggcctcccctcttggccctcaaacggccggcgtccctggcctctcgcgccgccgcttcgggcctctggttgggagtcctgtccggcctgacttaggccgagcgcggcgtgcgcgtgcccccagtccccgcggcggtctcccgcctggcccacgcccaccatgcgcatccacccctgtggcggccgggccgggttggggggctgtgaccggtcctggcccccggcttcgctgtgctttccccgaggcgtctcgatcgcctagctgctgcgctctttacccttgtttttttctgtcgattctgaggtggtgttttttggtgtctgtttttgccctgtggccttagggtgcccttcctgtcccttctttcagaaacagtcattctgtaataatagctaaataaagttaatgctgtacaactaacgtcttgtttcttgatggtcagtttgtatggaatgcacctgcaagggtacctccttgtctgaaagtcgtgctttaaaaataattaattaagagagagagagagaaagatggcccataaggaaaactctgaatgtctcctgtattaaggtgaa

SEQ ID NO: 374374 - DNA, 2147 bp, Homo sapiens
atgaacggctacggctccccctacctgtacatgggcggcccggtgtcgcagccgccacgggcgcccctgcagcgcacgcccaagtgcgcgcgctgccgcaaccatggcgtcctgtcctggctcaagggccacaagcgttactgccgcttcaaggactgcacctgcgagaagtgcatcctcatcatcgagcggcagcgggtcatggctgcgcaggtggcgctgcgccggcagcaggccaacgagagcttggagagcctcatccccgactcgctgcgcgctctgccagggcccccgccgccgggggacgccgtcgccgccccgcagccgccgccagcctctcagccgtcgcagccgcagccgccgcgccctgctgccgagttggccgcggccgccgcgctgcgttggactgccgagccgcagcccggggctctgcaggcgcagctcgccaagccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacagaccgccgcttgaagtgttaaaaaagatattccccaaccagaagccaacggtgcttgagctcatcctcaagggctgtggcggggacctggtgagcgccgtggaagtccttctgtccagccgatcctcagtcacgggagcagagcgaacttccgcagaacctgagagtctagcgttgccctccaatgggcacatctttgaacacaccttgagctcctaccccatctcgtcttccaaatggtctgtgggatcagcctttcgagtcccagacacgttgaggttttctgccgactctagcaacgttgtccccagtcccttggctgggcctctgcagccccctttcccccagccaccccggtacccgctgatgctgaggaatactttggcgagaagccagtcgagcccctttttgcccaatgatgtcaccctgtggaacaccatgacgctgcagcagcagtatcagctgaggtcccagtatgtcagtcctttccccagtaactctaccagcgtcttcagaagctcgcccgtccttcctgcccgcgccacggaagaccctcggatttccatccctgatgatgggtgtccatttgtgtcaaagcagtccatttacaccgaggacgactatgacgagaggtctgactcctcagactctagaacactcaacacatcatcttaaagtggtgctggatgggtggtggccaggtgacattttctgtgcgttttgaccctgaggcatctgaggagaggccacatcttgtgtatgccctttccttctgtttgacaaagtgactgtgcttgattctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacgagc

SEQ ID NO: 374375 - DNA, 1899 bp, Homo sapiens
tttgatttctagatctttatttacagggtttttgtttcatttgccagtgatatagttcgaatttttttaaaaaggcttgtagtatattatgacccattgagatgcatttgctcttccaaaaagcacgtgtacaggtctcttctgagcacatctgctcctctttatgcacaccaggaaaagattaactcagctgttctgttttccagatttgactgaagaacgacttggagacggcaagtcggcagacaatacagaggtcttcagtgacaaagacactgaccagaggagttccccagatgtggcaaagagtaagggctgcttcacccctgagagccctgagatagtgtccgtggaggaagggggatacgctgtccagaaaaacggaggcaaccccgagagccgccctgacagccccaagtgtcacgcggagcagaatcacctcctgattgagggcccctcggggactgtttctctgcccttcagcttgaaagccaacagaccgccgcttgaagtgttaaaaaagatattccccaaccagaagccaacggtgcttgagctcatcctcaagggctgtggcggggacctggtgagcgccgtggaagtccttctgtccagccgatcctcagtcacgggagcagagcgaacttccgcagaacctgagagtctagcgttgccctccaatgggcacatctttgaacacaccttgagctcctaccccatctcgtcttccaaatggtctgtgggatcagcctttcgagtcccagacacgttgaggttttctgccgactctagcaacgttgtccccagtcccttggctgggcctctgcagccccctttcccccagccaccccggtacccgctgatgctgaggaatactttggcgagaagccagtcgagcccctttttgcccaatgatgtcaccctgtggaacaccatgacgctgcagcagcagtatcagctgaggtcccagtatgtcagtcctttccccagtaactctaccagcgtcttcagaagctcgcccgtccttcctgcccgcgccacggaagaccctcggatttccatccctgatgatgggtgtccatttgtgtcaaagcagtccatttacaccgaggacgactatgacgagaggtctgactcctcagactctagaacactcaacacatcatcttaaagtggtgctggatgggtggtggccaggtgacattttctgtgcgttttgaccctgaggcatctgaggagaggccacatcttgtgtatgccctttccttctgtttgacaaagtgactgtgcttgattctatacattagcaataaaaacataacttatttaacttcttgcacttcactggaaaatgccaaatagctctgttctgtggctttagtgctgaatgtttattgtaaaagagagtctaatgttaagaatagtcttgggaaggctgggtccgtggaagatttatttggggatgtaaagctgaaggtcagccttgcacctaaacccaacctggaatgttaaatgaaataatatacttgaatgcaattttgtaaaagtggattcctcaggatatgtgaaacctaaaggaagtggttctgttgcaaatggactataaacagggacattatattcttacactaaaaatccttgcattttaaagagagatgcacttaagaatagagtgaactgctcatatgcttatttaagcttggacagttttcagagacaaaccccattaagaattactcttttcacatggctgaatcgaaacatgtgtaatgtcaatgtaaaaccaatcacagctgtgaactgcatgaaatgtattgtgaaacgaacacaagattaagctttgtcaggttaatgtagcatgttaaggactctagaaaaaaataaactaaggagacgagc

SEQ ID NO: 374376 - DNA, 2333 bp, Homo sapiens
caaacaaacataagtcaaaccatcataagttaagttagggaccatctgtatacttttttatcttatttaaatagcatccttattatagaagtttgaaaattacaaataaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagtttataatcataccaccagtatataagagtacctattctacaatagtttctttcttcataactaatttatacccaaaaaagatctgattttgttttgttttataagaaagactaaaatacttgtctgctatttggcaatttataaatccccactgtccagattgaaagtgctatcaacactcctaattcattagtagttcgagggtttctctaaaagagacagacttgggacaaagttggaaatcaacctgcattttcatacagccgcttaagacatttaagtttgactccatctacttagaacaattcaaaatgtgaatcttgcaactccagtggtcgttatgatcatttagtattgcccacaggggaagcagaattacaacccaggatggaacaaccttttggtcatttctgttcccattagtattgttagttttgttatgctgagcacactacaaagttgcatctcttgtataagtacaacacaatttattaaatattgtatacatagaaccaagaatcgataggatgcagggctgcttgattgtaccagaaacaaaacatgatgagaatacattgaaacactggatttacttaagaaaaacctaagtttttcaaatctaatttatttaagaaaacgtattttcttaataagtgtaacacagttcttacaaggtatggtaataagcagaaagtagaattttgaatattaatgtcaaagtatgttttctgccattttgatggagttgatactttttcttgtaagttcttcctgtagtgaaagagagaaagtgaggtgtcattgccgaaaggacacactaataacctcttggtagtttattgcaggtaaaatcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatctcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaacaggccctaaaagaggcagcaacagctgaagtggatatcacagaaataaacagacagcagaagctcttcagacacccccgaaacctgccaaaactcacaggtaatacaagtgaaacgatagcataagaagaaaataaacatgagaatcttcaa

SEQ ID NO: 374377 - DNA, 4919 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374378 - DNA, 4909 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggaccccgttgtcccctgttttcatttcccagggcccggcgcccacgatgtgtttatatttttcgggctccggggggctcaccatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374379 - DNA, 4443 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374380 - DNA, 4810 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggagagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374381 - DNA, 4166 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaaaaaaaaaaaaaaaaaaaaaaaaaaaaaaaaacacacaaaaaaaacaaaaaacacacacaacaacaaaaaaaaaaagagcgagggggggacccccgctgcccccccgaggggcccccacaagccacgcgcagcccgccaccctcaggcgcgcacacagacgcgaggggccaacaaggaggcggcccagacaaaacaagaacaccgggggcgaccagaaacgacaggacaacaacacagacgacgcacacgacgaaaggagacaacacaggcaggacgcctcgccaggcaccgggggggcaggacaaacacaaaacgccgcgcggggcgaccgagagacacacacgaagggaggggaacacaccaaacgcagtagataaaacagagagaataatacccggcacgcaacacgagagagaaaaacacacagacacccaggcccccacccaggggcgaaacacaaagacggctccgaagaacaagagcagcaccgacaaatgaaaacccacatccccgaccgcacacgacaaaccactatagcccaccaccaagcaccaaccaatgaccacgcaccaccaagagacaaaattctcaaaacaagggcacgatcacacagaccagtaacaacacccagccagatgagagagcataaaggatcag

SEQ ID NO: 374382 - DNA, 4190 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374383 - DNA, 4214 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374384 - DNA, 3655 bp, Homo sapiens
ccggggcggacggagtcctgggacccacaaccccgaccacacagcagtcacagcagctgtagccggcgcgcagacgtaacacaaaagtcacaaactgacagacggcaccccacgcggggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374385 - DNA, 3402 bp, Homo sapiens
  misc_feature (25)..(25): n is a, c, g, or t
gatgaagcttcttcatgaagtaaanaatgtatttaaaagaaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374386 - DNA, 3680 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374387 - DNA, 1932 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtgg

SEQ ID NO: 374388 - DNA, 2576 bp, Homo sapiens
ccggtaccgcagctgctcccatcagagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374389 - DNA, 1927 bp, Homo sapiens
cccgtatgttatccccaacacccaaatctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374390 - DNA, 1094 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagactagtcttgaactcctgacctcaagcgatctacctacctcggcctttcaaagtcttttatttttggttaataact

SEQ ID NO: 374391 - DNA, 2058 bp, Homo sapiens
ggtacccccaaatgggatccctataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374392 - DNA, 1686 bp, Homo sapiens
gtttccccccttccccaacaaagggccagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374393 - DNA, 5059 bp, Homo sapiens
  misc_feature (1)..(1): n is a, c, g, or t
ncgtctcttgttgttgagttttgttcttctgtcgttgtttgtgttgttctttcggtttctctttgtttgtgttatttgctttttgtcctgcgccgcgcgggtggactacgatgtgctcgttagaccgtgagcgcccgaacccttgttttccagccgcgggcgcccgcttttttttgtggaaccccccccattccagaccggtttcttggacccttatggaccagtgtccatacctacttggtccgcgggccccacccgagtggtttaataccctctcgtggcccgcgccccccaaaatttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374394 - DNA, 4883 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374395 - DNA, 4392 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactgtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374396 - DNA, 4057 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggagagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaaaaaaaaaaaaaaaaaaaaaaaaaaaaaaaaacacacaaaaaaaacaaaaaacacacacaacaacaaaaaaaaaaagagcgagggggggacccccgctgcccccccgaggggcccccacaagccacgcgcagcccgccaccctcaggcgcgcacacagacgcgaggggccaacaaggaggcggcccagacaaaacaagaacaccgggggcgaccagaaacgacaggacaacaacacagacgacgcacacgacgaaaggagacaacacaggcaggacgcctcgccaggcaccgggggggcaggacaaacacaaaacgccgcgcggggcgaccgagagacacacacgaagggaggggaacacaccaaacgcagtagataaaacagagagaataatacccggcacgcaacacgagagagaaaaacacacagacacccaggcccccacccaggggcgaaacacaaagacggctccgaagaacaagagcagcaccgacaaatgaaaacccacatccccgaccgcacacgacaaaccactatagcccaccaccaagcaccaaccaatgaccacgcaccaccaagagacaaaattctcaaaacaagggcacgatcacacagaccagtaacaacacccagccagatgagagagcataaaggatcag

SEQ ID NO: 374397 - DNA, 4258 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagattgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374398 - DNA, 2788 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataagttctagctgaagtattgtgaactccaaataatgctttgaggacctccaaaggtaaaagtactaatccctttggccatttattgagagagagagagagagagagtagggtgcgggggacatctatggttttggtgttcggcacacacaagaatttgcgggggggggcaacaccgggttgtaaccctgtgtggacgctccccttaacttttccaaaaaaaattctgcgcaaagagaggaatccgggcacattgggttt

SEQ ID NO: 374399 - DNA, 3164 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaggacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374400 - DNA, 3024 bp, Homo sapiens
  misc_feature (19)..(21): n is a, c, g, or t
  misc_feature (44)..(45): n is a, c, g, or t
tccgaaccccgtccccggnnnttttattgggggaaacccacccnngtccggcccggtgttcctggggacccgcttgtggcccggtgcctaacctactggcgcccggcgcccacacggaatggtttaaaaaccttttccagggcccaagccccccacaaatttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctccccaaatgctgggattacagatgtgaggcacctggcctcagatttttgatactcttaaaccttctgatccttagtttctctctcccaaatactctttctaggttaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgtgtgtgggtttttttttttaaaagccacacaataattttgggaaaacaatgtttgggtagaacatgtgtctgttaattgcacacaaaaccacttttaatgggtacagagttaaatttgaaggaataaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgatgcacaaatgtaagtacatcagaaaaaaacaaaaaaactggctttaaagcaggagcttgtgggcccctaagccagacggggactagctttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaattttgtatttctagcagagatgaagtttcactatgttggccaggctgggctcaaactcctgacctcaagtgatctgcccgccttggccccccaaagtgctgtgattacaggcgtgagccaccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagct

SEQ ID NO: 374401 - DNA, 212 bp, Homo sapiens
gctgttgcaaaaagaaatataaacagcttaacaccagaaggaagcaaaactatatatgtctttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaa

SEQ ID NO: 374402 - DNA, 2227 bp, Homo sapiens
gtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaa

SEQ ID NO: 374403 - DNA, 1351 bp, Homo sapiens
  misc_feature (1)..(1): n is a, c, g, or t
nttagtgtgaatcaaggatgtggttcactatactgttcttaccattgaaaaagaagtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaa

SEQ ID NO: 374404 - DNA, 2259 bp, Homo sapiens
gtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaaaagtgatactgtaggagaagctgaagctcata

SEQ ID NO: 374405 - DNA, 1019 bp, Homo sapiens
ggacgcgtgggtcgacccacgcgtccgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaa

SEQ ID NO: 374406 - DNA, 1198 bp, Homo sapiens
gtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctccgaggagatgtggagatcccaaatttgattgatttgaagacatgtgagaggttgactagatgatgatgcaaatgtagcc

SEQ ID NO: 374407 - DNA, 437 bp, Homo sapiens
gctgacttacaggattggggctagctgttgtcttcttccctatactctgttactgcaagttttcaacagaaatgaaatatctctaatttttttgtaatgtaaagttatttttaaaatattttggaacaatgtgcttgagtagctaaaattatttttatgctatgaaaatgagccatgtggctggatgtggtagtcacacctgtaatcccagcactttagggggcagaggtgggaagattgcttgagcccaggagttcgagacttaggcaacatgttaagaccccatctctacgaaaaatttaaaaagtcaaaaattaactgggtatggtggcgcacacctgtattcccagctacttgggaggctgaggtgggaggattgcttaagcccaagatctcaaggcttcagtgagctgtgattgtgccactgcactccagcc

SEQ ID NO: 374408 - DNA, 943 bp, Homo sapiens
ggccacgagaccagcagcatgcacggtggcacgggcactggtctaccaggactgtccctcaggagggggtcaaacttgaggtataaggactacttcctcgtttaaggagtcggccttgaggaagcagcattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatact

SEQ ID NO: 374409 - DNA, 1626 bp, Homo sapiens
ggccacgagaccagcagcatgcacggtggcacgggcactggtctaccaggactgtccctcaggagggggtcaaacttgaggtataaggactacttcctcgtttaaggagtcggccttgaggaagcagcattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggttacttgatttgcatctggaatatgattatttaaagaaattaaaaatttaaaactgaaaatgtagagtttagaaatcttttttaaggtttcaaaaaaatttctaggagacaacaaaatagtgttactagatttagcaaataaaatacagaatgccaattaaatttgaatttcaaatgaacattgaatactttttttggtataactatattccatgcaatatttgggacatatctgttatattattcattgtttacctgaaattataatttaaactgagagttctgtattttatctggcaaccttattatgaaaatatttaggatcaatataaaggaataatatttttaatttttacaaactattttaatataagtaatttatttgattttcattgtcatcctgagagttaagtt

SEQ ID NO: 374410 - DNA, 1164 bp, Homo sapiens
gacttgtggcctccgctggagctgccgccgccgtatccgccgccggagctgctgccgccgccggagctgccgcccccgtagccgccgccgccgccgccggaactgccaccaccgtagccgccgctggaactgccgccgtggccgccgctggagcttccgcccccgtagccgccgccggagcttccgccgccggagcttccgcctccgtagccgccgccggaactgccgccgtggccgccgccgtggccgccgccggagcttccgccgccggagcttccgccgacgtagccgccgccgaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatact

SEQ ID NO: 374411 - DNA, 1126 bp, Homo sapiens
gacttgtggcctccgctggagctgccgccgccgtatccgccgccggagctgctgccgccgccggagctgccgcccccgtagccgccgccgccgccgccggaactgccaccaccgtagccgccgctggaactgccgccgtggccgccgctggagcttccgcccccgtagccgccgccggagcttccgccgccggagcttccgcctccgtagccgccgccggaactgccgccgtggccgccgccgtggccgccgccggagcttccgccgccggagcttccgccgacgtagccgccgccgaaacttccgccgccgcgtccgccgcctccggaactaaacgggatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatact

SEQ ID NO: 374412 - DNA, 1683 bp, Homo sapiens
gacttgtggcctccgctggagctgccgccgccgtatccgccgccggagctgctgccgccgccggagctgccgcccccgtagccgccgccgccgccgccggaactgccaccaccgtagccgccgctggaactgccgccgtggccgccgctggagcttccgcccccgtagccgccgccggagcttccgccgccggagcttccgcctccgtagccgccgccggaactgccgccgtggccgccgccgtggccgccgccggagcttccgccgccggagcttccgccgacgtagccgccgccgaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggttacttgatttgcatctggaatatgattatttaaagaaattaaaaatttaaaactgaaaatgtagagtttagaaatcttttttaaggtttcaaaaaaatttctaggagacaacaaaatagtgttactagatttagcaaataaaatacagaatgccaattaaatttgaatttcaaatgaacattgaatactttttttggtataactatattccatgcaatatttgggacatatctgttatattattcattgtttacctgaaattataatttaaactgagagttctgtattttatctggcaaccttattatgaaaatatttaggatcaatataaaggaataatatttttaatttttacaaactattttaatataagtaatttatttgattttcattgtcatcctgagagttaagtt

SEQ ID NO: 374413 - DNA, 1235 bp, Homo sapiens
gacttgtggcctccgctggagctgccgccgccgtatccgccgccggagctgctgccgccgccggagctgccgcccccgtagccgccgccgccgccgccggaactgccaccaccgtagccgccgctggaactgccgccgtggccgccgctggagcttccgcccccgtagccgccgccggagcttccgccgccggagcttccgcctccgtagccgccgccggaactgccgccgtggccgccgccgtggccgccgccggagcttccgccgccggagcttccgccgacgtagccgccgccgaaacttccgccgccgcgtccgccgcctccggaactaaacggggtgaggtcacattcggttatctctaacgttggaaaacggtgggtagctttccagttgccgttaatttagaaaataagcaaaacgtgttgaaaaaataaaaccctgccagatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtcccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatact

SEQ ID NO: 374414 - DNA, 1000 bp, Homo sapiens
gacttgtggcctccgctggagctgccgccgccgtatccgccgccggagctgctgccgccgccggagctgccgcccccgtagccgccgccgccgccgccggaactgccaccaccgtagccgccgctggaactgccgccgtggccgccgctggagcttccgcccccgtagccgccgccggagcttccgccgccggagcttccgcctccgtagccgccgccggaactgccgccgtggccgccgccgtggccgccgccggagcttccgccgccggagcttccgccgacgtagccgccgccgaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcccttcctcaagtattcttaaagccatggatttttgtggagcatttttcttcctggctctcccttgagttattttcctttcttcgctatcttgggactcttctttgtgcttgcggacatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatact

SEQ ID NO: 374415 - DNA, 403 bp, Homo sapiens
  misc_feature (276)..(276): n is a, c, g, or t
  misc_feature (281)..(281): n is a, c, g, or t
ttctccctctagccttattccttgtttctgactccctgaaggcctacaaccccacttacaggtccttgttgcttttgtaagccaggggagtgatgctgttgaatactcttcctcaaaagcatggccttttgtggctcccaattttaaacacacaggtcaattgcaattctctgactctcagaagcctaaagtcttttctcctcacctcatatagcccttaaaactatggttcccactccccattggccattttggctttagctctctttcatatcnaaganggtcttcgtcccatcagtctaacaaaaacaagtagggaaacaaccaaagaataaggcaactcctgtgagcttcacaaaagtgaattcatcgaaaaagacagcgcctttaaattccttgtttc

SEQ ID NO: 374416 - DNA, 3821 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggagctgtctgagcaaactggccacaggccgtgagtgaaagcaaagcagaagcctttctacaagacccatctcctgccaagaacccctccctgacgcctccactcgtggggtctgggataggctctttaccttctcagaggatggaggcaataccattcactgggcagtcactgtgaatattgaatgagataaaacatggcagtgtctacagcgccgggcacatagtactagataagtatttgttaaataaattaatgatcggagacattcactctcatcttccaaagttgtcagttatttctgggattaaataacacctaccctactgagactctacttatgccaagccctattctaagcacttgacacgtctcactgacatcttgcaatgacccagcaggaactgttattcccacaatttttaaacagatgaacaaactgaggagccagaggttaggtaacctgttcaaaatgacacaactagtatatgactagtcacagctcacagccagatgcatctgacttcaaagcctacattcactactagtatgctatacaggtgacatcttaaaaggtaccttggcctcatgtcccacaaagtcaatccaggcattaaaaaggacatggggctgggcatggtggctcacgcctgtaatcccagcactttgggaggccgaggcaggaggatcacttgaggtcaggagttcgagaccagcctggccaacatggtgaaaccctgtttctactaaaaatacaaaaattagccgggtgtggtggcacatgcctgtatcccagctactcaggaggctgaggcaggagaatggcttgaacccaggaggcagaggttgcagtgagccaagattgtgccacttcactccagcctgggcaacagagtgagactctgtctcaaaaaaaaaaaaaaaagaaaaa

SEQ ID NO: 374417 - DNA, 2980 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggaagatgcgcgcagtcttctcccatcagattgtgtgacacgtcgttggactctttttataaccaacaaaggtcaatgtatagaaatccg

SEQ ID NO: 374418 - DNA, 3845 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattataaatggtttaaaatacgtattcttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggagctgtctgagcaaactggccacaggccgtgagtgaaagcaaagcagaagcctttctacaagacccatctcctgccaagaacccctccctgacgcctccactcgtggggtctgggataggctctttaccttctcagaggatggaggcaataccattcactgggcagtcactgtgaatattgaatgagataaaacatggcagtgtctacagcgccgggcacatagtactagataagtatttgttaaataaattaatgatcggagacattcactctcatcttccaaagttgtcagttatttctgggattaaataacacctaccctactgagactctacttatgccaagccctattctaagcacttgacacgtctcactgacatcttgcaatgacccagcaggaactgttattcccacaatttttaaacagatgaacaaactgaggagccagaggttaggtaacctgttcaaaatgacacaactagtatatgactagtcacagctcacagccagatgcatctgacttcaaagcctacattcactactagtatgctatacaggtgacatcttaaaaggtaccttggcctcatgtcccacaaagtcaatccaggcattaaaaaggacatggggctgggcatggtggctcacgcctgtaatcccagcactttgggaggccgaggcaggaggatcacttgaggtcaggagttcgagaccagcctggccaacatggtgaaaccctgtttctactaaaaatacaaaaattagccgggtgtggtggcacatgcctgtatcccagctactcaggaggctgaggcaggagaatggcttgaacccaggaggcagaggttgcagtgagccaagattgtgccacttcactccagcctgggcaacagagtgagactctgtctcaaaaaaaaaaaaaaaagaaaaa

SEQ ID NO: 374419 - DNA, 4138 bp, Homo sapiens
ccgagttgtctacgctgcttttcctcgctgatcgggttcccatcatcggtgttttttccgcggtgatgcgtctggatggtgccgttgtaccccccggtgggtggtctcctccattactccctcgtgctgtgttcgcttcctgccgtttgttcgcgcgggcgctccctgttatctacctgtttgtggcgcgtctttttctttacacgcggtggtggtttcttgtcgccccttccgtggggattatataccccccccccctcttttttttttttttttctctttcctcttttttttttcttttttctttttttttttccttttttttttttttttttttttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggagctgtctgagcaaactggccacaggccgtgagtgaaagcaaagcagaagcctttctacaagacccatctcctgccaagaacccctccctgacgcctccactcgtggggtctgggataggctctttaccttctcagaggatggaggcaataccattcactgggcagtcactgtgaatattgaatgagataaaacatggcagtgtctacagcgccgggcacatagtactagataagtatttgttaaataaattaatgatcggagacattcactctcatcttccaaagttgtcagttatttctgggattaaataacacctaccctactgagactctacttatgccaagccctattctaagcacttgacacgtctcactgacatcttgcaatgacccagcaggaactgttattcccacaatttttaaacagatgaacaaactgaggagccagaggttaggtaacctgttcaaaatgacacaactagtatatgactagtcacagctcacagccagatgcatctgacttcaaagcctacattcactactagtatgctatacaggtgacatcttaaaaggtaccttggcctcatgtcccacaaagtcaatccaggcattaaaaaggacatggggctgggcatggtggctcacgcctgtaatcccagcactttgggaggccgaggcaggaggatcacttgaggtcaggagttcgagaccagcctggccaacatggtgaaaccctgtttctactaaaaatacaaaaattagccgggtgtggtggcacatgcctgtatcccagctactcaggaggctgaggcaggagaatggcttgaacccaggaggcagaggttgcagtgagccaagattgtgccacttcactccagcctgggcaacagagtgagactctgtctcaaaaaaaaaaaaaaaagaaaaa

SEQ ID NO: 374420 - DNA, 3003 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggaagatgctgtcccatcgtgggaaggtgctgtggtgagtttagggaaagctggggtaggaggggagtgggagagcccgtggagacccctgaagatcctgatgggagcagact

SEQ ID NO: 374421 - DNA, 3257 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggatcttgctcccatcagtagacaccacctagttctttctgtagtgaagggaggtagtgtgtattatagccacatttttatcctgctttgtaaaataaatgtaacttactctattagatctcagacacatctctttgattacaaggaacatgcagctttaaaaatgctttaaccccaaactggcaacttttctatcacttttttactctgttttcaagtttgaaatatttagaaaataaagatcacctctgacagttattgatgaaaaataaattgttttagatattataactttgatgtttaatgctctcaatttaaaactctgacttggaacaaagtgctgtggtttataagacctgatgagggc

SEQ ID NO: 374422 - DNA, 3009 bp, Homo sapiens
  misc_feature (2893)..(2893): n is a, c, g, or t
  misc_feature (2898)..(2898): n is a, c, g, or t
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggnaaganggtcttcgtcccatcaggtcagagccaagaaatatggcaggattattccttagaatataacactaaattttctttagagttatccaagatgctgatgggacgaagattgcg

SEQ ID NO: 374423 - DNA, 2626 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagaagaaattaataaatgaaatcctgaact

SEQ ID NO: 374424 - DNA, 3305 bp, Homo sapiens
tggatcccccgggctgcaggttttttttttattaaagatcataatgctatcatttattgaagaaagaaagcaaaaaaaactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggaaatacacacaataaaaaatcaaatcctggaaaagaaatacttaaaagacattgaaattataaaaagaaagcatgaagaccttcaaaaggctctaaaacagaatggggaaaaatcaacaaaaacgatagcccattatagtggacagcttactgctctgacagatgagaacacaatgctccgttctaaactggagaaggaaaaacaaagcaggcaaagactgacgaaatggaatcataccatcgtagactgaatgttgctctacatgatcatgatcaaagtcactcaacagaaagagaccaagagcttgatttccagggcacagtagataaattgcgtcatttacaggaaaatttgaattctcatgttctgattctttctcagcaactttctaaagctgagagtaagtccaggtgcctcaaaactgagctccataacacaagagaggctctgaaagaaaacgctttggtttttgaacacatacaaagagagctaaaccaaacggtgtcaaatgaaggacattgaaaaaatgtacacaagtggccaagataaagtagaaaaatgcacagaaaagcaagtaagattatgtcaactacgaagacaaaatatgttgcttcaacagcaactggatgatgttcacaacaaagctgacaatcaagaaaaaacagtaactgatattcaagccaaatgtgatgctacagcacaaaatcttcaagctgagtgcataaagcaccgtcttttgctagaagaacaagaggatgatcaataaagttaatcatttgaaagaaaaacaatgtcaatatgaaagagagaaagcagaaagagaagtagttgtgagacaacttcaacaaaaacagggtgacgtcctaaacaatcaacaacaaaagctttgctggatgcttcattgcgtcactgcgtccattgagaaagtgagatgtaggattcaaggaagaaattaggtcagatgagaattcaatttcaagaaaaatggaatcaacttacagcgactataaaatgtactaaggagacgcaaggccacgtacaaaaacttgaaatagaaaattctagtgttaagaaatacaattaaaaagcaagatggccaaattgagcagcttcagaaaatcctgcgaagttcaagtttgatgcagcagttattgcaagaaaatgaaactacagaaatagatgaagcttcttctgaatttaaatctggatcctctgtagcagaggttcccaacctacaggccatggacaggtccatgacctgttaggaaccagctgcacagcaggagagttactgtggatcttctagatcatctgcatgccatgtgaatcttaaaaccagtttttaatttctacaaa

SEQ ID NO: 374425 - DNA, 3780 bp, Homo sapiens
  misc_feature (4)..(4): n is a, c, g, or t
agtnctacttttcctaccttgaaaatctatttcatttactaacaattgtgatgggggaggagagacagcttggcaacattccttttaaagttaagttagcataaagaaaacaatatttagtaaatgaaatagattttcaaggtaggaaaagtagtactcaagaatgtatttttggatacaaaaattcagttacacaatcagtagcattcaaaattagttatgagtatttatacaattacaaaaatggattcatgttttaacaacgtattttaaaagctcaaacattttaaaacaggcacaatattctaaaggcatatgcattcaccatgggcttttgaatgtcctcactcccaacttcacaatcaaaatctacagaagcggcaaaagatcagagttcagagggctattttttttttccctttccttacttaaggttgcaaacacattgacagaggcaaaataaacacgtttcatagcagaaagaccaaaaaattgaatgtaaaccatagctctcccttgggagattacacaaatacaaggttcatctgtacttagaacaaggctcataacttcttgtagcatggacattcaacaggcacagagcaacaacattcacccaaataccagctgcaatttgtcctttaaggatgcctcacaaggatattatgtccaggtagctagtccatttatatcggggaccagttgtccttttgttgtttgtggctgtttattaaatgtagtggcacaactttgttgtgaatatgtaccatcatttgctacaatctagacagatcatcctgtctacaaaaaatcattttctacatttctaagaccattatcagtttatctgctcctgctagaaaaggacatactttttgtcaatttacattaacaaaaggctctgctactccccatttactcgctgcaatgaaaactggtaagccaagggtaaagcttaagtatcagggactatgaatttagggtagaagtgaaaataaccaaagtggaactaaatcccctattcttgagtgcaactgagatcaagtaaacttcgctggactttcttcttaactataaaactattaaccagaaggtaaagtcacacaattttacctcccaacaaacttttaaaataaaaatttccaaaaaatttagatgtctaggttttgttatatcttaccaagagttacacagacataaatttgtatttaacttcagttaaacatctattcactttttaaaaatgctgtctgcaaataaactactggacatcttaagcttactaaaaaaaacttaagatttttaaattaaaaaaaaaaaactaggacaaaaatctagcaaatggtttcacgtacctttaaacactgattcttaaaaatttatatgctgaaaatgaggtttgagaatacgtattttaaaccatttataatcctaccgtcgactctagtcagaagttatctgagcaaagagaaaataaagcctggcgtagacagtcccatagaaaatagaatccatagccactgggctgcccttcaatttcccaattcattccactaagtctcatgatgcaaatctgtcactttcatagagctatcaaaaacagaagccaagccagatcctccacactttaagatatggttccttattatctattttaacagaagtatcaaaaagtgatttttttttttatttatttttgagacagagtctcactctgttgctcaggctggagtgcaggggtgcgatctcggctcactgaacttccacctcctgggttcaagcaattcttgtgcctcagcctccctcccaagtagctgggattataggcgcacaccagctagcctggctgatttttttgctgttgtattttttgtagagatggggttttgccatgttggccaggctggtcttgaactcctgacctcaagcgatccacccacctcagcctcccaaagtgctcagattacaggtgtgagccactgcacccagccaaaaggtaattttatttggaatgcatttcatgattttatttcttgctccctgagcctgcagtgattagggtggaagggaagtggcactcaggcagataattcacaaagtcaccacacaagggtgatagatgatccaccactgagataatcaacccagtgaaaatgctacactggggaccatgttttgcccttcccagacaagacatcttgagctaggatctgagctacggctatgcagaggagcagaactgaaggctccgtttgagccctttctgcaaaaggggatgcatttcagataatgagacaagagacgggagtgagttagtacacagcacgcccaatacccaacaagcagcctcagagagactgggagaagggggagaggggactggaagccatctcttctgttctgaagggcagtgctcctcccaagacagcactcagagagccaacagcccagggcagatcacgccaggacagtgcttccatatggctggctgagcaccatattccaatctgcaaaagagtcaccttattggttcccttaacttccaaaatgcagcaagccctccttctcccatcagtgaacggaagggaagggaatgcagggcagcagggagacagagaccatcattaactacaggtctgaaaccctaattctttactcactcatcaggttgcttttaatcactgctgttgcttggtaacaggtttcagcagatttgaaatggatttcttcctcccacagtctaacaaaaacaagtagggaaacaaccaaagaataaggcaacttaaggaaaaacgcaggaagaccctgggaggcagggtcatgcaaaagctgccaatggtgtcctgatgggagctgtctgagcaaactggccacaggccgtgagtgaaagcaaagcagaagcctttctacaagacccatctcctgccaagaacccctccctgacgcctccactcgtggggtctgggataggctctttaccttctcagaggatggaggcaataccattcactgggcagtcactgtgaatattgaatgagataaaacatggcagtgtctacagcgccgggcacatagtactagataagtatttgttaaataaattaatgatcggagacattcactctcatcttccaaagttgtcagttatttctgggattaaataacacctaccctactgagactctacttatgccaagccctattctaagcacttgacacgtctcactgacatcttgcaatgacccagcaggaactgttattcccacaatttttaaacagatgaacaaactgaggagccagaggttaggtaacctgttcaaaatgacacaactagtatatgactagtcacagctcacagccagatgcatctgacttcaaagcctacattcactactagtatgctatacaggtgacatcttaaaaggtaccttggcctcatgtcccacaaagtcaatccaggcattaaaaaggacatggggctgggcatggtggctcacgcctgtaatcccagcactttgggaggccgaggcaggaggatcacttgaggtcaggagttcgagaccagcctggccaacatggtgaaaccctgtttctactaaaaatacaaaaattagccgggtgtggtggcacatgcctgtatcccagctactcaggaggctgaggcaggagaatggcttgaacccaggaggcagaggttgcagtgagccaagattgtgccacttcactccagcctgggcaacagagtgagactctgtctcaaaaaaaaaaaaaaaagaaaaa

SEQ ID NO: 374426 - DNA, 1847 bp, Homo sapiens
caaacaccacatgttctcactcataagtgggagttgaacaatgagaacacatggaaaagggaggggaacatcacataccggggcctgtccgggggtgggggctaggggagggataacattacatgtatacctatgtaacaaacccgcatgttctgcacatgtaccccagaacttaaagtataatttaaaaaaagaagtatttccagaatctcatataaaaaaagaaaattaaaaatgcagtttatttatgtaaaagatcagtggaacttaaagataatcactgagtgacttacagtaaaaattaaaaaatgaaaaagactagtgtactacaaaagagactatctgaaaaaaaagaaatatcacagaatatcaaaaactcgaatgggaacaagaactctgcagtttgagatttctgatagtcatgaaaaagaagaagacctgttgcataaaaaccatttgatgcaagatgaaattgccaggctcaggctggaaatacacacaataaaaaatcaaatcctggaaaagaaatacttaaaagacattgaaattataaaaagaaagcatgaagaccttcaaaaggctctaaaacagaatggggaaaaatcaacaaaaacgatagcccattatagtggacagcttactgctctgacagatgagaacacaatgctccgttctaaactggagaaggaaaaacaaagcaggcaaagactgacgaaatggaatcataccatcgtagactgaatgttgctctacatgatcatgatcaaagtcactcaacagaaagagaccaagagcttgatttccagggcacagtagataaattgcgtcatttacaggaaaatttgaattctcatgttctgattctttctcagcaactttctaaagctgagagtaagtccaggtgcctcaaaactgagctccataacacaagagaggctctgaaagaaaacgctttggtttttgaacacatacaaagagagctaaaccaaacggtgtcaaatgaaggacattgaaaaaatgtacacaagtggccaagataaagtagaaaaatgcacagaaaagcaagtaagattatgtcaactacgaagacaaaatatgttgcttcaacagcaactggatgatgttcacaacaaagctgacaatcaagaaaaaacagtaactgatattcaagccaaatgtgatgctacagcacaaaatcttcaagctgagtgcataaagcaccgtcttttgctagaagaacaagaggatgatcaataaagttaatcatttgaaagaaaaacaatgtcaatatgaaagagagaaagcagaaagagaagtagttgtgagacaacttcaacaaaaacagggtgacgtcctaaacaatcaacaacaaaagctttgctggatgcttcattgcgtcactgcgtccattgagaaagtgagatgtaggattcaaggaagaaattaggtcagatgagaattcaatttcaagaaaaatggaatcaacttacagcgactataaaatgtactaaggagacgcaaggccacgtacaaaaacttgaaatagaaaattctagtgttaagaaatacaattaaaaagcaagatggccaaattgagcagcttcagaaaatcctgcgaagttcaagtttgatgcagcagttattgcaagaaaatgaaactacagaaatagatgaagcttcttctgaatttaaatctggatcctctgtagcagaggttcccaacctacaggccatggacaggtccatgacctgttaggaaccagctgcacagcaggagagttactgtggatcttctagatcatctgcatgccatgtgaatcttaaaaccagtttttaatttctacaaa

SEQ ID NO: 374427 - DNA, 1870 bp, Homo sapiens
gtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcgtcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagttt

SEQ ID NO: 374428 - DNA, 544 bp, Homo sapiens
tggagtctcatgagaatgcactgcatgatgcagaaatagcatgtaagctccgcccgatgggttttaaggtgagtgtgggatggaagaggtgggaaggggttgtactgtagacaggaattggcaggaagggctgcctccctggagcataggggcactagagctcaagcagaacaggaagaagactttgcaaaggagccagggtaaagatccctgggcaaagagtgactcaggtctgcaagggagctggattcttccccaattcagtcttcaactcatgaccttcagagcagcctgggcatagtgactctctagaatatgcacttgggagccagactgcctgggtttatgtcccaactctgctaacttttatgacctttgtggccctgggcaaatgacttaacttcccagtacttcatctcctcatctgttaaatgggggatattcaaagcagctactaaagagggctgttgtgaggattacataagctaataatgtaaggtgcttagaacagtgtctggcatgtagcactatataaacgttctct

SEQ ID NO: 374429 - DNA, 2138 bp, Homo sapiens
gtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggcacatttcagaaaagcccaagccttagccaccctaggcaaggtggaggaggcactaagggagtttctctactgtgtatcccttgatggaaagaacaagagagcaagatgtgaagcccaaagagacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcgtcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaagtggttttgctttaatattctttctttcataggatcaatgactgtgtggttgaaatgtgaaaacaaagatactaataatgttgctgtataatttcactgacttgaggtctcattccaaatggttcaggttttatagagcatt

SEQ ID NO: 374430 - DNA, 719 bp, Homo sapiens
tgcacacgccgaatgtccacactgacaataaagttgctctgagtttggaacactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctccttgggaactgagacatatctcagggaatggtgtctgtgctcagcccatccaccagaagagtctgctcacaagccaaaaaac

SEQ ID NO: 374431 - DNA, 1217 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374432 - DNA, 1404 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctccttgggaactgagacatatctcagggaatggtgtctgtgctcagcccatccaccagaagagtctgctcacaagccaaaaaac

SEQ ID NO: 374433 - DNA, 1122 bp, Homo sapiens
ttataggggtctgggatggaaacccttaagggcctctggcgtcggcggggcggggcctgatgctagcgtccgctttccagtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374434 - DNA, 1425 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtgctcaccctgtgggatggtggagacatcaaccagtctgactgtatacccattttgccggctgaaacaggcccagggagggatgggatttacccagccatcagaaagttgagagtggaaggggtcagacctaggccctgctagggccccgccagactccctttcctgtcttttatggagggtcaatggtgttctctgactccacaaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374435 - DNA, 1238 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374436 - DNA, 968 bp, Homo sapiens
ggggttggatttagagataagattgagtaaacatttatccaaggcaagatacagcaggagttgctaagcatttgatttgataacaagtactaataactaatagttggttgaaggaataacaaatgctaaatcagcatctgctgactggataggtggatggggaagggagagatgttcaataagtggtttattgggtgagcgacacagtgtacactctgaccagtcctctcttctaccctaactgccctgcagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374437 - DNA, 1562 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccaggtgcctggacgcctccccatcctcaggacctgattccccaccagtagtttctcccacaggccctcagttcctggcatccgctcctgttcatggcccccacccaggctccccctgcccatagaatgttttccccacacacaccttgtctgcagacaaagggcccattgcctctctgtggcctggggcatgtcactccatctctctgacactccatttcctcttttgtccccaggggggaaataaggtggtgggtgaggaaaggcttaggctatcacaggaggggtttttatcacccacccccaccccctttcatggcctcacagaactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374438 - DNA, 1181 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374439 - DNA, 1137 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374440 - DNA, 1483 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagaggtgaccttgtaggggcccatggggcggggcctgcagtaggggcccaggtggctataggcgtgaccctgtctctctgcagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctccttgggaactgagacatatctcagggaatggtgtctgtgctcagcccatccaccagaagagtctgctcacaagccaaaaaac

SEQ ID NO: 374441 - DNA, 1246 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggacttgaaggagctcaaggtgctagtggctgacaaggaccttctggacctgcacaagaggtgaccttgtaggggcccatggggcggggcctgcagtaggggcccaggtggctataggcgtgaccctgtctctctgcagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374442 - DNA, 1202 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374443 - DNA, 755 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagggtatgcactgcatccacacggacacagcatcccatctacacttcactccctccctttggccactggcccagttccagcctctgattgtggcagcagcttcatacctagtcttctcctcccttcccctttcccctccttttttttttttttttttcgagatggagtcttgctctgtggcccaagctggagtgcagtggcgcgacctcagctcactgcaacctccgcctcctgggttcaggtaattcttgtgcct

SEQ ID NO: 374444 - DNA, 536 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgcaaggatccttaatttaattaatcccccccccccggcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcga

SEQ ID NO: 374445 - DNA, 909 bp, Homo sapiens
ggggttggatttagagataagattgagtaaacatttatccaaggcaagatacagcaggagttgctaagcatttgatttgataacaagtactaataactaatagttggttgaaggaataacaaatgctaaatcagcatctgctgactggataggtggatggggaagggagagatgttcaataagtggtttattgggtgagcgacacagtgtacactctgaccagtcctctcttctaccctaactgccctgcagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374446 - DNA, 1245 bp, Homo sapiens
ggcacgaggagagagagagagagagagagagagagagagagagagagagagagagagagagagagagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374447 - DNA, 1307 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaactcagagcaacggggtgcggactagggcggccgagagccatggcggcgctattggcggcggcggcagtgcgagcccggatcctgcaggtttcttccaaggtgaaatccagtcccacctggtattcagcatc

SEQ ID NO: 374448 - DNA, 1299 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgggtgagcagccctgtcctcctgtccagcttggctttgccccagcctgccacctgccaggacctcgcctcctgcagactcaagacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374449 - DNA, 1496 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagggtctgtggtcccatccagcctctgacccttggcatcttcagcctccagttcgccacccctaccgggcagctctgcccctgccagggattggccggcaggtggcactgctgctccctctggtggccgctgacgggagcagctcataaacaatggggacttggttgatggagggaggtggatggatctggggaggggcctgctcctcctcccccagcttctgtgctcagctgccaacttctggggcagaaagcagagctccaaggatccctgccccacagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374450 - DNA, 1249 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaaagcagagctccaaggatccctgccccacagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374451 - DNA, 1116 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374452 - DNA, 1425 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttggagactggtcctcgctccggggagcaagtggggggcgtgcagatgtgcctgtgtctgtctctgagcacctggtgtccgtgtacaaggatggatgtgtacagtggctccttgggaactgagacatatctcagggaatggtgtctgtgctcagcccatccaccagaagagtctgctcacaagccaaaaaac

SEQ ID NO: 374453 - DNA, 1575 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagaggtgaccttgtaggggcccatggggcggggcctgcagtaggggcccaggtggctataggcgtgaccctgtctctctgcagcctggtgtgcactgctctccggggaaagctgggcgtcttctctgagatggaagccaacttcaagggtctgtggtcccatccagcctctgacccttggcatcttcagcctccagttcgccacccctaccgggcagctctgcccctgccagggattggccggcaggtggcactgctgctccctctggtggccgctgacgggagcagctcataaacaatggggacttggttgatggagggaggtggatggatctggggaggggcctgctcctcctcccccagcttctgtgctcagctgccaacttctggggcagaaagcagagctccaaggatccctgccccacagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374454 - DNA, 941 bp, Homo sapiens
aagaaggaatttcaagccctaagaggaccctcctctcgtctgtgcagggactatgcagccatcgtcttctttgctaacaaccgctttgagacagggaagaaaaaactgcagtatctgagcttcggtgactttgccttctgcgctgagctcatgatccaaaactggacccttggagccgtcgactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagggtctgtggtcccatccagcctctgacccttggcatcttcagcctccagttcgccacccctaccgggcagctctgcccctgccagggattggccggcaggtggcactgctgctccctctggtggccgctgacgggagcagctcataaacaatggggacttggttgatggagggaggtggatggatctggggaggggcctgctcctcctcccccagcttctgtgctcagctgccaacttctggggcagaaagcagagctccaaggatccctgccccacagaacctgtcccgggggctggtgaacgtggccgccaagctgacccacaataaagatgtcagagacctgtttgtggacctcgtggagaagtttgtggaaccctgccgctccgaccactggccactcagcgacgtgcggttcttcctgaatcagtattcagcgtctgtccactccctcgatggcttccgacaccaggccctctgggaccgctacatgggcaccctccgcggctgcctcctgcgcctgtatcatgactgaggtgcctcccaacgctccgcccacgctgacaataaagttgctctgagtttgga

SEQ ID NO: 374455 - DNA, 561 bp, Homo sapiens
ctcggcgctcccggaagtggcctgaaggcggcgcgccagtcccgagcagtgctcgctcctgctcggggcgctgcggccccgggcgtcgccatgaccagtgagctggacatcttcgtggggaacacgacccttatcgacgaggacgtgtatcgcctctggctcgatggttactcggtgaccgacgcggtggccctgcgggtgcgctcgggaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagttttgtcatctttatatcgttcttcaatgttggtagattgttatactggggttctcttgt

SEQ ID NO: 374456 - DNA, 885 bp, Homo sapiens
  misc_feature (33)..(33): n is a, c, g, or t
aggggcaacaacatagatacgacgagctggtgnattcggccgaggtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgttgagacctacgttttggccagtcccagcaggaagatatctgaggaatctagaggtgaagagcctgaacccagagcccccagcccgagggagaagtgagggagaaggaaagccagaggacttgctgattaacactcggtcaagttattgctaaaggtctgtgaa

SEQ ID NO: 374457 - DNA, 1010 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgatgtgcaggtatttttgagactcggatcagatatagaacttcgaaaggggaactgtctgggggcaggatttataagtagtgggttgggtacattccacaggcagggaaaagctcttcggagataggacataccgggatggcacaggagagaaagcccaattgaagacgtaatggggtgagggtgaagggaggatgatatagaaagattgaagaagagcgggagggaa

SEQ ID NO: 374458 - DNA, 662 bp, Homo sapiens
gcgtatggtgtgtttttatgtgtgttctgtcttttttattgtggtggtgtggttgcttgtgtgtttgtgttgtgtggtggtgtgtgcttggtgtggggtggtgcggggcgccgtcttttgtttggtgtttttctgtgttttttgttgttttttgtttttttgtttttcttttttttttttgttgttttgtttgtttttttcatgttttttttttttttttgttttttttttttttttttttttttttttttttttttttttttttttttttttttttttttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374459 - DNA, 246 bp, Homo sapiens
ctctggaaaaggggcaccgcaccaagcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374460 - DNA, 6670 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374461 - DNA, 5745 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaatttta

SEQ ID NO: 374462 - DNA, 6566 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374463 - DNA, 6655 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgatttgtttaccagtaataattttgacttgcttcagttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374464 - DNA, 5431 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374465 - DNA, 5077 bp, Homo sapiens
tggtatacctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374466 - DNA, 6402 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcaccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374467 - DNA, 3869 bp, Homo sapiens
  misc_feature (33)..(33): n is a, c, g, or t
aggggcaacaacatagatacgacgagctggtgnattcggccgaggtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374468 - DNA, 3923 bp, Homo sapiens
  misc_feature (33)..(33): n is a, c, g, or t
aggggcaacaacatagatacgacgagctggtgnattcggccgaggtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374469 - DNA, 3589 bp, Homo sapiens
cataataaagagtgcttgtattaggatacagtagcaaaatcacccccacatcacagtggtttattctgaccaaagcatttattttcattccatttacataggaggtggcattgtagaaaataaaaactttctcaaagagatatgaattaaagaaaagttagagtaaggtgaatacttatttaaacatacctttagagtgagggtaagcccccttcccaacccaaaatgaactgaatgagagagaaaaagaggtccagagtagtttgtggagcgatgtttccatctctaatgccactcagctcaggagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374470 - DNA, 3482 bp, Homo sapiens
cataataaagagtgcttgtattaggatacagtagcaaaatcacccccacatcacagtggtttattctgaccaaagcatttattttcattccatttacataggaggtggcattgtagaaaataaaaactttctcaaagagatatgaattaaagaaaagttagagtaaggtgaatacttatttaaacatacctttagagtgagggtaagcccccttcccaacccaaaatgaactgaatgagagagaaaaagaggtccagagtagtttgtggagcgatgtttccatctctaatgccatcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374471 - DNA, 4096 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaatctttgttaaaattatctgaaaaatttctgaattgcttttctttgttatcttgaagatcactgggtttccttaaaactgctattttgaaagttggttagagtttacatattgccttctcattagggctagtcactggttcctgagttatctatttgggaaa

SEQ ID NO: 374472 - DNA, 3970 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttggttgttgtgtctttgtctgattttggtgtcagggtaatcttggcctcatagaatgagtttggaagaattccttcctcttccatttcctggaagaggttgagaagaattagtatcggttcttctttacaggtttggtagaattctgctgttaagctcattgggttgcgatg

SEQ ID NO: 374473 - DNA, 3001 bp, Homo sapiens
ccaagaattcggcacgaggagagtcacactgacatgaagggcttatctgccattctatttatagcctgaaatgattctggcctaccctgtcctgtctgtatgatctaaaaaccagccttttcgccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374474 - DNA, 4430 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374475 - DNA, 2716 bp, Homo sapiens
aggataaacaaacacattatataactcccaagaaaatacatacactaatacacaaacccaaaatagtctctcactgtctctctctctttcacacacactaactcatgctcatttatgcatgtacaacctaccatcacaatcataacccacattctcagcctcacacctccaaaggtatatacacacctcacacgaatatatatacacacaagccaccgtaccaggctggctgctgctccactcctcactctctggggtgctagcagtgggttgtccctctggtcctttccttcttcttgcttctcctgtagaaggcaagcctgatcccagcttcttctttatattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374476 - DNA, 1991 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaaggaatccaagatacgttcatcttttgatgtcgtctttgatgcacagcttctactgtccatgggaaagaagaaggtgtatggaaagcactcaagatacttaactacattaacctggaaattactatcaatcatcaccacttacaattttttggctacaagtagtcacatggccctacttacatgcagaagtactgggaaaagtagtccctggctgggcagcctttcctcatcaaaactctgtattctgtagtataatatagaactctatacttaaatctt

SEQ ID NO: 374477 - DNA, 1687 bp, Homo sapiens
cccccgggctgcaggaattcggcaccagctttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374478 - DNA, 578 bp, Homo sapiens
aggatggaggaaccgcgagtggctcaggacccatgtgagagacagaaaacaatgctctttgtggccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374479 - DNA, 458 bp, Homo sapiens
aaaaaaaaaaaaaaaatctttttcagggcataatgtttcctgattatctttttagaaaatgtggacataaaaaggaaaaattacatatgtaattgtatatgtaataatcacacatatctgcagaaataaccagatgcattgaaaaaacacacacatgccacttctttagtggagctaatgacatacattttatatcccacttttttctctcgagattgttattatttactttctcatctagtaatttatacatctgagttttctaatttcttgttttgttgggtttttttttttttgccttcctccccgtagatcttgagccagatgattgtgcatccatttacatctttaatgtagatccacctccatctactttaaccacaccactttgcttaccacatcatggattaccgtctcactcttctgttttgtcaccatcgtttcagctccaaagtcac

SEQ ID NO: 374480 - DNA, 994 bp, Homo sapiens
  misc_feature (994)..(994): n is a, c, g, or t
ctagctggactctcggtccggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctgagtgcttcagcaccccttcctcgacatgagctccgcccaatgaggagaagggtcttctgcattggccggtggtggtcccctatccaattagagaggctaacggccttctctcgtctggtttagaaggaatcgccgggggaatacaggccaaactacaattcccgagagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccgcggtctgtcagaacttctcatattgggaagtcagtttcacgcgtggtctgtacatgggcgctgcacgcggggcggctaacattttccgaacccaccttttggaacggccatgtggacccggagggaggggaatcagcgcgtggggcctgtgcttaggtccttaacacaggggcgggggccatggggcggagcgacgcgttttacgggcgccaacaaagggtgttgtgcgccagccagtgtgggaggcatccctctcttgtcccccccttttggn

SEQ ID NO: 374481 - DNA, 6668 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaacagacacaacacaggcaaacgacaaaattttccccagcgccccacctttgtctcctcaaagtctcgtgtgtgctgctggacgtcgcttcgttgtttggaggaaatgccgcggttgtgtccatctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374482 - DNA, 4623 bp, Homo sapiens
  misc_feature (4623)..(4623): n is a, c, g, or t
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaaaaaaaattttccaagccccaccccttttgccctcagaaagagtctcagccgttgttgtcccggaagaaagcgttccatatagaaatttttagtggggaaaaattaagggcccagagtggttcgcctcaattcccctcttttattaaaacactataaccgccgtggtcgatcagaatatacaagctgtggagaagagaagacccattcccatctctattggaaagggtgcgtggagaaattcattacaagagggacactttctctccagagagaccatataagccgctgttttgtgcgggaacacactttctctcagagagagaaaacaactctgtgtgccaaagactctttctctccaaatgtaaggggggcgctcacccagagtgtttggacaacatgttgggcgttgttttccccccctcttgagagagacacccctgtggcgtttaagagagagtggggctctcaccatttttcaaaggggcgcgacaaccctgtn

SEQ ID NO: 374483 - DNA, 6178 bp, Homo sapiens
agagtaatccctattttttcttgcctgatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374484 - DNA, 6620 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374485 - DNA, 4282 bp, Homo sapiens
tcattagcttgatttcctagatgtacaagcccgttgacttggccggtctctgacttggaaacacccttctcgtttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374486 - DNA, 3844 bp, Homo sapiens
ccccggcctgtaggaattcattgccgagtcgacacgatttcgagaagacgaccgaagggagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaag

SEQ ID NO: 374487 - DNA, 3860 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatatgttaatatataactttgccaggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgccattgcactccagcctgggcggcagagcaagactccgtctcgggaaaaaaa

SEQ ID NO: 374488 - DNA, 3582 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgttgagacctacgttttggccagtcccagcaggaagatatctgaggaatctagaggtgaagagcctgaacccagagcccccagcccgagggagaagtgagggagaaggaaagccagaggacttgctgattaacactcggtcaagttattgctaaaggtctgtgaa

SEQ ID NO: 374489 - DNA, 2891 bp, Homo sapiens
agggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgatcaggacagcaggatgatcaggacagcaggatgatcagagcaggatgatcaggacagcaggatgatcaggac

SEQ ID NO: 374490 - DNA, 769 bp, Homo sapiens
ctgtccacgtacttaatttacttaagtgttcattttaagtaacgtgctcactgtgtataggaatttgtattttgcaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgttttcactgtatgtttttactgaatgatctattccccatcccaaggcaagcatgaatacaattaggttaaacgtaaaaaaaaaaaaaaaacaagggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagcatcaagaaatcgcaggaaaggtgaaagaagttaatttgcaaaaaaaaaaattaaaatttaaaaaaaaaagc

SEQ ID NO: 374491 - DNA, 220 bp, Homo sapiens
tttttttttttaatttaaaggctttttattaggaaccaggggaatgagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatca

SEQ ID NO: 374492 - DNA, 3525 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttaaaaaaaaa

SEQ ID NO: 374493 - DNA, 1993 bp, Homo sapiens
ctgtccacgtacttaatttacttaagtgttcattttaagtaacgtgctcactgtgtataggaatttgtattttgcaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgttttcactgtatgtttttactgaatgatctattccccatcccaaggcaagcatgaatacaattaggttaaacgtaaaaaaaaaaaaaaaacaagggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttaaaaaaaaa

SEQ ID NO: 374494 - DNA, 2603 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgcttgttgccttgaacctcgtgccgaatt

SEQ ID NO: 374495 - DNA, 3781 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaaggtatgactattctaatttaactaacttctcatgtaagtgtcaagtgcacttgcagatgtttccagtcaaatatgaatggcccttagaaagccagcatgggcctggccaaggttagctggggcctattccctgtatttcatacaaataaaaactgcatccacattggtgtgtagtggatgcttaaagtgaactccagtaaatttcctgatttatttttacgtgaatgctaattagaaaatgtaactctattttttagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttaaaaaaaaa

SEQ ID NO: 374496 - DNA, 1250 bp, Homo sapiens
gaggcagaagttgcagtgagctgagatcgcgcagcctgggtgacagagcgagactctgtctcaggaagaaaaaaaaaagaaagtaagcatgtgtaattcttatttaaccttttatattgatcaacagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttaaaaaaaaa

SEQ ID NO: 374497 - DNA, 1001 bp, Homo sapiens
tttttttttttaatttaaaggctttttattaggaaccaggggaatgagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatatagctaacagcttttaaatttttacttttaaccagtctggggatttgcttgcctggtgagtctcatatgccatattatgaatatgaaaataatgaagttaatttcctgttgcctttctgtgtcagccacaatatcaggtctaaccctaatccagggatgccagtaaactgaaggcaattttaggttgtagaactcagattaattgtagaaaccattaattttaattgctctaattttcatagtaatcataaaaagtatgcaagtacctaatatataaactcaattgacactgtatctgtagaagtaaatttttaatggctggttaattatatcactacattttattgcaatatagtactcatttaagcacttaaaaatggaaggtgtacaaagattaaattaagacacggtaaattgactaaatatttggtttttatataaataaaggtcataaccacaccgttaaaaaaaaa

SEQ ID NO: 374498 - DNA, 2661 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaaggtatgactattctaatttaactaacttctcatgtaagtgtcaagtgcacttgcagatgtttccagtcaaatatgaatggcccttagaaagccagcatgggcctggccaaggttagctggggcctattccctgtatttcatacaaataaaaactgcatccacattggtgtgtagtggatgcttaaagtgaactccagtaaatttcctgatttatttttacgtgaatgctaattagaaaatgtaactctattttttagttaatttgcaaaagaaaaatgaagactgtggtaatgagtcttttgtttcatttgggatgtaaaggagacctttaagagagttaaa

SEQ ID NO: 374499 - DNA, 2794 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcaggttcggagcccgctgcccggcggggagaaccgccctttctcgtcccgcttgtccttccctttgctgacttatcacccttcctcccagggataaaacgctcctgaaggagaagaggaagcgacgcgaggagctgttcatcgaacagaaggttagaggctagggaggaggtgtcttattaaaacaactcggctcagggagaattcctatggtggatgtaatttgggttggcaggatattggagtggggaaacagtcaccaagattgcctctgacagtggtggaaagatgctcgggccgggcgcggcagtactttagttggacgaggtgggcggagcccgggatgtcgaggctgcctggagccgagatcacaccactgcgctccagcctgggcgacagagcgagaccctgtctcaaaaaaaaaaagttcgtctcctttagtgtccaccaactgaaaataagaggttgctgtgagaattaaatgaggtgatttgtaaactgtaagggctgtacagacttagtgtatggttgctttgctgtctgatactcgacacagagagctggctccaggcagacattacttaactgctttcaatttataacagtgacctgagggttagaataccgtgg

SEQ ID NO: 374500 - DNA, 917 bp, Homo sapiens
ttcgactggagcacgaggacactgacatggactgaaggagtagaaagtcagggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatca

SEQ ID NO: 374501 - DNA, 2744 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatca

SEQ ID NO: 374502 - DNA, 3153 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtacttttgttcttgccacagtctctccttagctgttcactcattgcttgcagctctcgtccaaagtggatcattctttctatggcggcctgacttcctccacacaactggcgtctcaactgacttgaatcaacttctgtaagaaaaacagacaagtattttactaccttatggaatggagtataatgaggacacgaacatacatttcttataccattttgtacatttagtaactattccctaatatttcatctaaatatgcagattgttaaaaattcatttttaatatgaaactgcagctaaaagatatactttatttagctctcaagagtctaggatccagtattcagcatgcagttgagaggggacaacctttcagtgttagagggtacttatgtcagaaaaaaattttagaaaaagtataattccctaaaactacattaagcaacatttaa

SEQ ID NO: 374503 - DNA, 2631 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgaaatagtttctgttttggcaacagggttccgttgaagagtgtgccgttttgaataggtgggaatcaacaatgcaagttacgaggtgtgtgaagataatttatcagag

SEQ ID NO: 374504 - DNA, 2360 bp, Homo sapiens
cctgaagtgattacatacttggaccacatcacctcagccccttgcaaaattgcatttaatgttacacccttggcttttgtagaaacaggcagcaagacactatcatataaaactttgtactgcattgcaaggcataacctttaataaatcccagtggtcctttgtgtagggaacggggatgctcatagcctatggggcggctggagaaccagtcagggaccctgagggctcgatgtacactttacatgggtgggccaaggagtttacactgagggcactggtaatacctgtaatagtcttatagtacttataaagcagttttgcacataaaataccatcatgcacttataagtttgttcttgggctgctccaagttaactttattcattttcctagtgttagtgtctcagggagtctgattatatttttgatttgtaatttctatctgactaaggcctagagatttcaaaactgttctttgcaattcctctcatactgaacctctggttcagcagctttttttgttgttgttgttttcaagttttatcatttttgttcctatttggttttgtcgtttttaaattgagaattgcttctaaaacagaagacatgaaaagagaattaaaaatacaatatatgtgtaagatagaattattcaacttagcatttattaaacatctaccagatgatagacattagaaataaaatgactagcaagacctggcccttcccctcaggggttcacagaatggctggagcaactgtcatataagctgttatgaagtgcagaaactacacagacatttgtgcgggttcagaccagcgcaattagagatgggcagagtgggatggggtaggggtaaggtgcttgaaatttgcctgggtgggaatttttgaagtataaaaaggacttctacctggggggctgcggcagtagagggaagagcacggtcggtacaaatgcatggcaggtgtgaaacagtttgatttgttcaaagaatgatgaatcacttagtgttgtataatggatgggaggagagaaacacagcgatcacaaagggccatgtttgccaagaaataaaatatacttggaaaaaaagtacgtatgtgtatataccacaaaactcgggtgcattctctagggaccggcgaagccattctttcaggagatatgctcagcatttgccacgggccagctgctgttccaggtcgtgggttagggcccggcaccaggaagggcgcccctcccacagggccgacatcctaaccggcgtcgctgcggccgcggagctgggaaggccgagggcgccgggcacgtctgtgcagatttctttagagtccaggtctgtcgcccgcgtcttcgtcggtggcagcagggctgactggccacggcggccatctgctagagcgcatttcttcccatgaaacgccacctcctccgaagtgcggagcgaacgcagccaaatctacacaaagactgacaagctggatccactcgacggaacccagggccaaaaaacggcggcgagcagcgcctcgggcccgcgattaccggttttctgagcaccggacagcgtgagccgtgccagccctgtctcgccatcccagccgaggagggcagcgcgatggctcttccctgccttgaaatcaaccccattgccagccgctttcgccggcagagcattttccgtggggtccatccggctccaaggcggcctgcgctggccacgtggaaagaaacacgcccactgcctacaggccacgcccttcctcccttcgcgcatgcgccccacccgtcctgaggacctccgaacctgcagggggcgatgaaagtaggcttgcgctccgcttgtagctgcttccgggtcagaggtcagaggtcggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgcaggaaaggtgaaagaagttaatttgcaaaaaaaaaaattaaaatttaaaaaaaaaagc

SEQ ID NO: 374505 - DNA, 580 bp, Homo sapiens
catagatcctaggagacagggattttttttcttttcatttgacctaacccagggactgcttgagcactatttattccctatatccttgcctttcacaaccaacaaacctatctgtatgtggcactgtgccaagtactgtagtccataagttaaaaatatatatatcggccaggtgcagtggctcacgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374506 - DNA, 390 bp, Homo sapiens
ttttttttttgagacagagtttcgctcttgttgcccaggctggagtgcaatggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374507 - DNA, 379 bp, Homo sapiens
ctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagcggaacagtctttgggttcacgctg

SEQ ID NO: 374508 - DNA, 833 bp, Homo sapiens
tgatgcctctgctgcctccttcatagggtgagagataggtttcagcatgggctctaaggagctgactgatcttgtccttgtgggtcccttccacagagcctagcacaaatcatcagggcttagggaccaggaagtcagatgcttagttctcaaatagaaactagagagtttggctttagaggggacttttgtagatgaggaaactgagccccaaagaagggaggttccacttgcccatttgtttacagagttttaattatggggagtggggtgttgaaagactcatcatgttttaacaacctttttttttttccaagggatatcttctaaccataccgatgattctccgtatagctggtcttttccaccttatcatccttcctctgagaagtatgaaaacactaaggtaaggctgtgaaagggacatttctgaagaggaaccactttttcctttgtcacataaactactgggtatactgcatgttctgtgaagctggttatataccacgaagttgtgggtttcatttgtgataatgttttgacagaagtaagtgttgggatcttcagcattaggcccgacagggaccgggggtcctctagaagccggggggggcacacggtccaaaacacgggggcccaacggggccaacccctggacccccggggcacccgggagaacgcaatgtggacaccacccagacggggggaggccctcgcccccacgggagagggcgaccgcctagccccgccacggcgtagaacaacaacagcgagcgagcaccaacagaccgcacacagcggggccacgacgcgactgctaccgcgcgcatagt

SEQ ID NO: 374509 - DNA, 399 bp, Homo sapiens
tgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactga

SEQ ID NO: 374510 - DNA, 6086 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374511 - DNA, 5922 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374512 - DNA, 5912 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374513 - DNA, 5942 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374514 - DNA, 5922 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374515 - DNA, 7519 bp, Homo sapiens
  misc_feature (988)..(988): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374516 - DNA, 4752 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttaatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374517 - DNA, 6398 bp, Homo sapiens
ctgatgcgcgccagccaaccaggccaaggccaggggacctcgagaccggcagcctcgacgaagaaccggaaggaggaaaaggaacgggagggaggaagatctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcagtgagatgcgcctacttctccctggagaagctcgaggaagcaggaatgctggagatgagacccagcacaccctgcctgcatggcgctgcgctgcaccttcactctggtcacgggtctggcagtcggctcaccaattcgtcctgcttccctgggactcgccggcttttagcactgcaattcactcagcaaactgggactgttggtcaccctacctggcagccagtgataagggctggtgtcattggcatgacagacctgccttggctgagcgttcacccgtcttcggagttcagccaccttagcaagtcctgggtttgttcttcagattttgctgctcgcccattgcctggatcgggggctactttgtaaaccaccaggaagactccagtgtttctgcttaatttttagatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagttctaacaccaaagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374518 - DNA, 6202 bp, Homo sapiens
ctgatgcgcgccagccaaccaggccaaggccaggggacctcgagaccggcagcctcgacgaagaaccggaaggaggaaaaggaacgggagggaggaagatgagatgcgcctacttctccctggagaagctcgaggaagcaggaatgctggagatgagagacctcgtctgctcaggggcttgttcttacatcttttgcagggctgttttgaagtcagtattcacttaagcactccaaattacccagcacaccctgcctgcatggcgctgcgctgcaccttcactctggtcacgggtctggcagtcggctcaccaattcgtcctgcttccctgggactcgccggcttttagcactgcaattcactcagcaaactgggactgttggtcaccctacctggcagccagtgataagattttgctgctcgcccattgcctggatcgggggctactttgtaaaccaccaggaagactccagtgtttctgcttaatttttagatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagttctaacaccaaagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374519 - DNA, 4510 bp, Homo sapiens
ctcgcgggctgtaccaattcggctcgagtcctgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374520 - DNA, 3256 bp, Homo sapiens
gacaggccaagtgcacaagcattgcagtgcactgcatggtcagactagaagaggatcaccacataaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374521 - DNA, 2313 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggta

SEQ ID NO: 374522 - DNA, 2388 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaa

SEQ ID NO: 374523 - DNA, 1781 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggaggaccaaagttccacaggtttcagactgaagacttcatctaccagaaagtataagtaggccagggctcagcataatcctgctggaaggctagatgtatatcttttctcttgactgcaagtgagaacggcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcaaaaaac

SEQ ID NO: 374524 - DNA, 1541 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagaaccctgcccttctcttaccacatgaatgctgtggcaggcaagctatagcggatggaagatggcagtgttttcaaagtgtgcatcctggactacctgccttagaatttctgggagggcttgttggaaatgcaaagtcttggcccactcagatttacacaattggaagctggaggtggaacttgacctgacaaccgacatttcttaa

SEQ ID NO: 374525 - DNA, 3966 bp, Homo sapiens
tcggccgccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcggga

SEQ ID NO: 374526 - DNA, 3771 bp, Homo sapiens
  misc_feature (23)..(24): n is a, c, g, or t
  misc_feature (29)..(29): n is a, c, g, or t
  misc_feature (37)..(37): n is a, c, g, or t
aaagtatagccagttccttcccnntggcnactatgtntggatgttggatctacactttctcaagcactgtgatcttcaatcaaaggagatttctcccattatatacttcttatgatcaacaaattccatcatctccccactaagagaaagtactccaagatgatagaatgattttaaagttatgggactacaacagcagccacaggaaccttgaacccctgcttgaaactgcttgtacattagagacagagaagagtccatgagaatcaacattttctgaggactccaactgtgtgccaagagagttcccctgctggtgcctcctctgtagtaaaggaaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcggga

SEQ ID NO: 374527 - DNA, 3076 bp, Homo sapiens
  misc_feature (988)..(988): n is a, c, g, or t
  misc_feature (2867)..(2867): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtggtcacaaggtccccgtctgatctgccttcactccacctttcagagtcttatgtttgttttgtgtatattatcaaggggttttaggtcacttagtcggaagaatagggaaaagtatgtctactccagcttaatggaagtggaattctcctgagaacctttttttgatacaaaatatgtacttgtgcatattttgtatcaaaatatataatgtacatgtcccttttgtacatgtatataaattgtatataaatatttagggttataaaaataaccaaagacaccaaaaactgccacaggtggatttgagaagatgtggaaatgcctcactgctaagacatgctcattcttgacaggctgggaaccctgaatgctgtagtgtcaccactgccctgtcctgtacctacctatcttttcactcatttcctccaagctcaggttttcagtttggggtatgtgccacctaacagtgagctgtggaactgcagcacaatcatcaaattcaaaaaaggcaaggacatcttgctcagtttttaagatacgccatagatggagtaaaccanaacctttgattccagatccttaaccctgattaaaaacaacacaacccttcatgttgatttaaaacatcccttgcaaaagatggtttgaatattccaagttggaaatacccagtcttttaaagttacagcaccctttttgatacaaaaaatgtgcatgacagaaattgtacagtgagtagtgttataaaaataaccaaacacaccaaaag

SEQ ID NO: 374528 - DNA, 999 bp, Homo sapiens
  misc_feature (790)..(790): n is a, c, g, or t
gctgagactttctatttttagtttgtttcaaatgcgttcttaattgcttaatgaagcatataatggtggctttcaatttttttacagataattctaacatctttgtcatcagtgttgacatctcttgattgtatcctgtcattccatttgagatcttcctggttctggctggcatcctctgacatcactccagcagaagaaagggaaggaacacgctgcattactgcgtggtcacaaggtccccgtctgatctgccttcactccacctttcagagtcttatgtttgttttgtgtatattatcaaggggttttaggtcacttagtcggaagaatagggaaaagtatgtctactccagcttaatggaagtggaattctcctgagaacctttttttgatacaaaatatgtacttgtgcatattttgtatcaaaatatataatgtacatgtcccttttgtacatgtatataaattgtatataaatatttagggttataaaaataaccaaagacaccaaaaactgccacaggtggatttgagaagatgtggaaatgcctcactgctaagacatgctcattcttgacaggctgggaaccctgaatgctgtagtgtcaccactgccctgtcctgtacctacctatcttttcactcatttcctccaagctcaggttttcagtttggggtatgtgccacctaacagtgagctgtggaactgcagcacaatcatcaaattcaaaaaaggcaaggacatcttgctcagtttttaagatacgccatagatggagtaaaccanaacctttgattccagatccttaaccctgattaaaaacaacacaacccttcatgttgatttaaaacatcccttgcaaaagatggtttgaatattccaagttggaaatacccagtcttttaaagttacagcaccctttttgatacaaaaaatgtgcatgacagaaattgtacagtgagtagtgttataaaaataaccaaacacaccaaaag

SEQ ID NO: 374529 - DNA, 4058 bp, Homo sapiens
  misc_feature (988)..(988): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagagacagagaagagtccatgagaatcaacattttctgaggactccaactgtgtgccaagagagttcccctgctggtgcctcctctgtagtaaaggaaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcggga

SEQ ID NO: 374530 - DNA, 2723 bp, Homo sapiens
  misc_feature (988)..(988): n is a, c, g, or t
  misc_feature (2514)..(2514): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtggctgggaaccctgaatgctgtagtgtcaccactgccctgtcctgtacctacctatcttttcactcatttcctccaagctcaggttttcagtttggggtatgtgccacctaacagtgagctgtggaactgcagcacaatcatcaaattcaaaaaaggcaaggacatcttgctcagtttttaagatacgccatagatggagtaaaccanaacctttgattccagatccttaaccctgattaaaaacaacacaacccttcatgttgatttaaaacatcccttgcaaaagatggtttgaatattccaagttggaaatacccagtcttttaaagttacagcaccctttttgatacaaaaaatgtgcatgacagaaattgtacagtgagtagtgttataaaaataaccaaacacaccaaaag

SEQ ID NO: 374531 - DNA, 1444 bp, Homo sapiens
ctccaacatgatagagtgattcgagagagttatgggatctatagacacatggccactaggcaagctctttgcatatagagtatccattgggataccctcgtagcatacctgcatgtgggtattaacttctagctcaaagtcacatttatgagcgacgctcgaggagtgggaaactcgtacgtctgctcctctcgaagatttagatacaccagaatggaagatcctaggttgctactcttgcacctgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgcctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcggga

SEQ ID NO: 374532 - DNA, 439 bp, Homo sapiens
  misc_feature (59)..(59): n is a, c, g, or t
aaaaaaagaaaggaaactgggaagaagtagtaaaccatctacctttccaactctatttntcaatacggcccttcatttgtacattacaacccatgtaggcttctccctgttcttcacatataacccactggttaccactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374533 - DNA, 1374 bp, Homo sapiens
ctgatgcgcgccagccaaccaggccaaggccaggggacctcgagaccggcagcctcgacgaagaaccggaaggaggaaaaggaacgggagggaggaagatctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcagtgagatgcgcctacttctccctggagaagctcgaggaagcaggaatgctggagatgagacccagcacaccctgcctgcatggcgctgcgctgcaccttcactctggtcacgggtctggcagtcggctcaccaattcgtcctgcttccctgggactcgccggcttttagcactgcaattcactcagcaaactgggactgttggtcaccctacctggcagccagtgataagggctggtgtcattggcatgacagacctgccttggctgagcgttcacccgtcttcggagttcagccaccttagcaagtcctgggtttgttcttcagattttgctgctcgcccattgcctggatcgggggctactttgtaaaccaccaggaagactccagtgtttctgcttaatttttagatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgccactagaggggcctgcattgggtacgggtgatggggtccacatggtacctggcatatagcaggctgtgcaatccatattaactgactggataaattaatgctcagaaaaggtgccctggagaatgggtgcgtgctgaacacaatagggaagggcccagcatctgccttggca

SEQ ID NO: 374534 - DNA, 808 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacaggtgccgcccacgccctccctgccatctcttctcccttcctccctcccttccttcctccttccttctttccttccttctttgtttatatccattctttttacccttcctctctcctaccattccttctttcatccatcattcgttccctccctccatttttcactccttcctaccgtcccttcatccctcccttccctctttccatctattcatccatccatctcctatccctccgtgcttcccttcctc

SEQ ID NO: 374535 - DNA, 503 bp, Homo sapiens
gcagcccagaatgcttggtttgctggtacttgcaggttccctctgtgggaaagcccatcctggctagctgtcactctcagggggtggcttggtgaacaggcccttggtgcagagggaactgggacaccatcatggccagtgccacccagctgtgatgtccggcattcctttgccatgatttaggggcggagcaaccacacaattagaatcctcacactgactcatcagtcaccctttctccctggagagcagaatacacattgactaatgctctttctggaatattccacacagaaccctgcccttctcttaccacatgaatgctgtggcaggcaagctatagcggatggaagatggcagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaa

SEQ ID NO: 374536 - DNA, 382 bp, Homo sapiens
atagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgc

SEQ ID NO: 374537 - DNA, 284 bp, Homo sapiens
cctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttca

SEQ ID NO: 374538 - DNA, 3268 bp, Homo sapiens
  misc_feature (1137)..(1137): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcagtgagatgcgcctacttctccctggagaagcttgaggaagcagaaatgctggagatgagacggagttttgctcttgttgcccaggctggtgcaatctcggctcaccactacctctgccttctgggctcaagcgattctccttcctcagcctcctgagtgctgggattacagagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagagacagagaagagtccatgagaatcaacattttctgaggactccaactgtgtgccaagagagttcccctgctggtgcctcctctgtagtaaaggaaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaattttttcaggaagaaagagagaatcagcaacatggcattgaaggtacccgttgacagtgacgtgcatcacagcattaacaggagaaatgcttgtgtgtgcaaatgggagacaaaggaaagggaccaccacatccatggagtgcaccgcgtgagagaaatgctcaggaagggaattgaccagattggctgtggagagaaaagagaaggaacatgggaggcagagctgagcaaccaggctttcactgctgaatgtctgagccagctccatcgtacaacaggagtgagggaagtacctgcttcacaaggttgtcatagccatcaaatgggatcacactctaaaggcagttctggaggccagaaatcagaaatcaaggtgtcagcagttccaagctccctgcgaaggctctaggggataatccttccttgcttcttccagcttctggtggatccaggtgttcctttggcttgtggccgtatcactccaacctctggctccatcttcacccttacctacttccctgtgtatcttgaatctcctgccactctcttataatgacacgtcattggatttagtgcctatttgga

SEQ ID NO: 374539 - DNA, 5976 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374540 - DNA, 5538 bp, Homo sapiens
  misc_feature (138)..(138): n is a, c, g, or t
  misc_feature (5500)..(5500): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccaaacaggtgggattacagacacacaaaattttcaagttnggggatatttaacttcagttcgtggtaaaaatcacatg

SEQ ID NO: 374541 - DNA, 5922 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttccttctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374542 - DNA, 6033 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtccatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374543 - DNA, 6189 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgcccttgtgggaacacatttttcagctgaatctttgttctcaagacctttttctgttagcattgggcctgcttcaagatgacagtagccaccactgtgtgccagggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374544 - DNA, 6042 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374545 - DNA, 6788 bp, Homo sapiens
  misc_feature (988)..(988): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtcttcctaaaatctctctttgatcctgtcctttgataacaccgtcagtgcctactactgggtctagacagacctctgttgagcagtcagagtcttccctgactccacaatgcccctttccttggctgaccagtatgactactggtccccacctttcccttgcctatccctacctccctcctactaggttgtcccatccctctcttcacccattcattcatgaccatttttcactaccaagctccccccctcccgaaggaggctgaggtttttgtgactctctagactctattgtgggatggaatgaacattgctaaagaatcttgtgttcgctttactttaaaaaggtatttttttcctaattataaaactgatgtgtcagttacggaaaaattagaaatgcagcacaaatacatgaatattttaccacgaaattgccatataatatcttgtcttttttgggggtgtgaattttttgcattgttctgatcatattctttatcatgtaatttatgttcttttttactaagtattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374546 - DNA, 3855 bp, Homo sapiens
  misc_feature (138)..(138): n is a, c, g, or t
gcgatctagacctagttagccaagtctctaacgtgacatagggaaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacagctcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttatcgcctgctccacagttctttacctttacttggcttagagaaactgtatctttgttgcttcatataacctttccccaaccccactaagctggacataacttattagtggtcctcccgtcactttatttgtagaaatattttgttttgctaggagtggtgctcatgcctgtcatcccagca

SEQ ID NO: 374547 - DNA, 1651 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcaaaaaac

SEQ ID NO: 374548 - DNA, 1603 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcagggactggtcgacgcggccgccatttag

SEQ ID NO: 374549 - DNA, 1570 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgagaagctaagtggaagagtgtttcctcctctggccgtaaagcagctgtccccgccctactccggaccgccccaaagactccatgggatggacctgagtcagccgaatc

SEQ ID NO: 374550 - DNA, 5692 bp, Homo sapiens
  misc_feature (988)..(988): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagagacagagaagagtccatgagaatcaacattttctgaggactccaactgtgtgccaagagagttcccctgctggtgcctcctctgtagtaaaggaaaggctcctgggaccacattatcattctcttcactcgagagatgaggacactgaaattcagagaggggaagtgatttgcctcagcttgtactaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcggga

SEQ ID NO: 374551 - DNA, 1602 bp, Homo sapiens
tcgcgtgggtggctttcggttcgtttggcggcctccccttcggtgggcctattggtcttcgcttcgtctgctgtgtctgcggtctgctctcgctgttcgtgctctctcgtgcttctcctgcctcactgagtcctgcttcgtccgtagtagttgtgtcgctccttggtttgctttttccctcacgcctcgttttgctcttcgcgtgctggatcctcttgtttcaattgtcgtctccctaccttgaggtgtgtcctgcgtttaatttcgcctcgctgcgagttggaatgtctttgtgtttccctaccactcaattatgtttctttctactatcctcttccctcctcctttcttgttatacatagtttagttccttcctctctgtcctgttgctttctctcctcgttcgtggctcgttcttgttgttctcctcgcttgctgctggtgctcgttgtttgcttgtattgctctgcctcgctgtcggtgtggcgaggtctgttatgtgattacgctgctccgttttttgtgggcgcgccctcttgtttgtccttcagtatgctggcgggtgctggcgtctttcgtgtgttggctcccccccgggggttgttcttgtgcgggcggcgccccccttttttttttgttttttttgtttttttttttgtttttttttgttattatgtgtggttattatagattttcacaaagatatattgctggtaatatattttattgtgtagtcttataatttacttaaccttctttcaattgttagaaatttaggctatttccagattttcagtattgtaaataatgctgtgatgaccaattttgtgaataaaatgtttttatgtatttcagattattcccttaggatagtctctcagtgccaagttgtcaaaaacatctctattttgcttatcttcctgctctcttgctgccttagggggtagtaaactgaaacataaagtaaacatgcatacaaataaaaaacataaaacaaaaataagcaacctgatggtaataggtgaaagtggtaacctgttttaactttgaattcttgccgggcgcggtggctcacgcctgtaatcccagcactttgggaggctgaggcgggtggatcacgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccctccccaatctggacattgaataaatattcattttcctttgca

SEQ ID NO: 374552 - DNA, 1623 bp, Homo sapiens
  misc_feature (248)..(248): n is a, c, g, or t
ttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgcccnggagggtgagtgggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacagatgctctgaacgttcttctcatcatcgtggatgacctgcgcccctccctgggctgttatggggataagctggtgaggtccccaaatattgaccaactggcatcccacagcctcctcttccagaatgcctttgcgcagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaatggagaaaaaagtattggaagacaagagcaccatagggacaataatgcttatcatttgggaatgacgaatgttttcagtctctttccctttgctcag

SEQ ID NO: 374553 - DNA, 2589 bp, Homo sapiens
  misc_feature (988)..(988): n is a, c, g, or t
acttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcagtgagatgcgcctacttctccctggagaagcttgaggaagcagaaatgctggagatgagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcgagacctcgtccgcacaggggcttgttcttctgtgtctttgcagggctgttttggactcagtattcacctaagcactccaaattacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggngagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtggtcacaaggtccccgtctgatctgccttcactccacctttcagagtcttatgtttgttttgtgtatattatcaaggggttttaggtcacttagtcggaagaatagggaaaagtatgtctactccagcttaatggaagtggaattctcctgagaacctttttttgatacaaaatatgtacttgtgcatattttgtatcaaaatatataatgtacatgtcccttttgtacatgtatataaattgtatataaatatttagggttataaaaataaccaaagacacc

SEQ ID NO: 374554 - DNA, 1401 bp, Homo sapiens
ctgatgcgcgccagccaaccaggccaaggccaggggacctcgagaccggcagcctcgacgaagaaccggaaggaggaaaaggaacgggagggaggaagatctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcagtgagatgcgcctacttctccctggagaagctcgaggaagcaggaatgctggagatgagacccagcacaccctgcctgcatggcgctgcgctgcaccttcactctggtcacgggtctggcagtcggctcaccaattcgtcctgcttccctgggactcgccggcttttagcactgcaattcactcagcaaactgggactgttggtcaccctacctggcagccagtgataagggctggtgtcattggcatgacagacctgccttggctgagcgttcacccgtcttcggagttcagccaccttagcaagtcctgggtttgttcttcagattttgctgctcgcccattgcctggatcgggggctactttgtaaaccaccaggaagactccagtgtttctgcttaatttttagatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagttctaacaccaaagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggttcgatatttttcagcactatccttaaccctgattaaaaacaacacaacccttcatgttgatttaaaacatcccttgcaaaagatggtttgaatattccaagttggaaatacccagtcttttaaagttacagcaccctttttgatacaaaaaatgtgcatgacagaaattgtacagtgagtagtgttataaaaataaccaaacacaccaaaag

SEQ ID NO: 374555 - DNA, 461 bp, Homo sapiens
gtctgttgcctaggtgacacccaaatcccagtgtctggtttgagctctgcatgactcagctaccaagctgtttgctaggagcctcgggaggcggttgcttggttacctaagagatggcagacatgttttgctgtggcgatgcttacctctgcttctgctccctaacagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgtggtgtctgaatccagcattcccatcctggggatggggctgtctttgcagagccctcttctggctgggcgagtccc

SEQ ID NO: 374556 - DNA, 853 bp, Homo sapiens
cttcagaccatctggatgtatacgtgcaggtcacaggggatatgatagcttagcttgggctcagaggcctgacattattgttactgtttttatctgtaattttctttcttcttcctttatcctagcaatgattgagagaatctaagttgaaacagataattgagaaatatgcctaatgaaatggataaagtgatgttctctatttctctctggcctccagaaatgtgtcctgagaatggatcttgtgtacctgatggtccaggtcttttgcagtgtgtttgtgctgatggtttccatggatacaagtgtatgcgccaggtgaggaattaggccgtctaactagggatacaaggaatgcatagagcaagtcttctcagaaaggagagccacaagaccaggagctgatacaaatttcctataggtggaaaactatagaattgccctagacaaagtgataggtatattaggaaagaactaggtgttaggatgtggccctccgtgtaacgttgtatgggggtgttttttggtctgttgttcacagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374557 - DNA, 1236 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374558 - DNA, 787 bp, Homo sapiens
  misc_feature (73)..(73): n is a, c, g, or t
ccgtctaaaggctcccggatccccagttccggacgccaaagttcaaaggccgtgtaccgcccgagactaatcncatgcccgttctgcctgaatcagaaggcaccttctggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374559 - DNA, 1273 bp, Homo sapiens
  misc_feature (1246)..(1246): n is a, c, g, or t
  misc_feature (1251)..(1251): n is a, c, g, or t
  misc_feature (1257)..(1257): n is a, c, g, or t
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttcttttaaaaaaacanaaaanaaaaancacaccggtcttgggg

SEQ ID NO: 374560 - DNA, 1356 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttcttttaaaaaaaaaaaaaaaaactcgagggggggccccggtcccaatttgggcctatagagggctgtttttccattcatggccggtggtttacaacgctggaattggaataaccctgctgtccta

SEQ ID NO: 374561 - DNA, 1722 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcactggccagccgtgcgtcgcgctcgccagcggctcccccttctcctcggcgggcctgcggttctgatttcgtccctgacgcttcccgaccctgcccagccaggtcctgttcccaagtactcacgtcgtgcaggccttcggcgccccagtcctgccgactttcaaagacctgtgaaacttgatttcgccccttaattttagaataactttaagttctttctacagacgggtcctctgcctcttgtgtaatctctctacgcacgaacgccatatatcgtgcggtggtagggctgtacttttgtaatgcttgatgagttctttacgtacctgcggtcgttttacaccgcgccaaactagggctgtcagattgagaagtctctgcagaaagcataataaataagttcgaatagtgatcttcagagatgaggaccttccctgtgcgatatctgatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374562 - DNA, 1169 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374563 - DNA, 1203 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactccctctccctaagaccctaggaatcctctaga

SEQ ID NO: 374564 - DNA, 1164 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374565 - DNA, 630 bp, Homo sapiens
cttcagaccatctggatgtatacgtgcaggtcacaggggatatgatagcttagcttgggctcagaggcctgacattattgttactgtttttatctgtaattttctttcttcttcctttatcctagcaatgattgagagaatctaagttgaaacagataattgagaaatatgcctaatgaaatggataaagtgatgttctctatttctctctggcctccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374566 - DNA, 1376 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcactggccagccgtgcgtcgcgctcgccagcggctcccccttctcctcggcgggcctgcggttctgatttcgtccctgacgcttcccgaccctgcccagccagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374567 - DNA, 2001 bp, Homo sapiens
  misc_feature (1295)..(1296): n is a, c, g, or t
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttcttttaaaaaaaaaaaaaaaaaaaaaaaaaaaaaaaaaaaaaaaaaaaaaaaaaaaaaaaaaannaaaaaaaaaaaaaaaaaaaaaaaaagaagtgtgtgggcgcgcgccggcgccccccaccgcgaaagaagagtccatcaaaaaccacccgcggcggagggggcgccggcgcccccgccaaagcagacacaagcagaaacgcgggacgacaaaagggtggtccacatgaaaagaaacacgagcggcggaagaaagcaagagacggggggcgaatccaccacaccccaagagaaaaaagagcgaggcgcgccggcgaaacaacagcgcacgcggtcggtccagacacaaccacaaccaggaggagcgaggctcgcgcggcgcgaagtacctacagcgcggggctcctaccccacgcaagggagcgcccaccacgcagagacagaccacataacaaatgaaataagaacgcggcacgagacgaggggggggggggggggtggacaaccaccgaaacaaagagaagaaagagagccaaaggaagcagacaacgacgaacgtgagggcgggaaggagggggggcgaggagggagaagagcacgggggcagcaggagaagacacgggggagccgcagggagcagcgacgagccgagaggcaagtaagaaagaggggggaggaaagcgagaacgcgggggcgggaggcggagagggagaagggccgagaacgcagacacagagaaggaagacggaagcgaaagaaggggaacag

SEQ ID NO: 374568 - DNA, 1984 bp, Homo sapiens
  misc_feature (1278)..(1279): n is a, c, g, or t
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttcttttaaaaaaaaaaaaaaaaaaaaaaaaaaaaaaaaaaaaaaaaannaaaaaaaaaaaaaaaaaaaaaaaaagaagtgtgtgggcgcgcgccggcgccccccaccgcgaaagaagagtccatcaaaaaccacccgcggcggagggggcgccggcgcccccgccaaagcagacacaagcagaaacgcgggacgacaaaagggtggtccacatgaaaagaaacacgagcggcggaagaaagcaagagacggggggcgaatccaccacaccccaagagaaaaaagagcgaggcgcgccggcgaaacaacagcgcacgcggtcggtccagacacaaccacaaccaggaggagcgaggctcgcgcggcgcgaagtacctacagcgcggggctcctaccccacgcaagggagcgcccaccacgcagagacagaccacataacaaatgaaataagaacgcggcacgagacgaggggggggggggggggtggacaaccaccgaaacaaagagaagaaagagagccaaaggaagcagacaacgacgaacgtgagggcgggaaggagggggggcgaggagggagaagagcacgggggcagcaggagaagacacgggggagccgcagggagcagcgacgagccgagaggcaagtaagaaagaggggggaggaaagcgagaacgcgggggcgggaggcggagagggagaagggccgagaacgcagacacagagaaggaagacggaagcgaaagaaggggaacag

SEQ ID NO: 374569 - DNA, 1945 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgaggtacagaagcaagtttgaggtcgggctgaagcagggtcactggccagccgtgcgtcgcgctcgccagcggctcccccttctcctcggcgggcctgcggttctgatttcgtccctgacgcttcccgaccctgcccagccaggtcctgttcccaagtactcacgtcgtgcaggccttcggcgccccagtcctgccgactttcaaagacctgtgaaacttgatttcgccccttaattttagaataactttaagttctttctacagacgggtcctctgcctcttgtgtaatctctctacgcacgaacgccatatatcgtgcggtggtagggctgtacttttgtaatgcttgatgagttctttacgtacctgcggtcgttttacaccgcgccaaactagggctgtcagattgagaagtctctgcagaaagcataataaataagttcgaatagtgatcttcagagatgaggaccttccctgtgcgatatctggtactgaaagtgtcgggagctgattcggcgcaggactctggaggaagagatggcatctcctagcctagcctgttacaagggtgggacacgagccgtttatccatttatcggccccgtgttagaggaattctggaaacgtgtactggcagttaattcttgatcgccgtttgttcttttcttggcttttctttctggagttctaatgtttctttctcttctgcagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374570 - DNA, 1459 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggcaaaagaacctttgcaataacactggggacccagaaatgtgtcctgagaatggatcttgtgtacctgatggtccaggtcttttgcagtgtgtttgtgctgatggtttccatggatacaagtgtatgcgccaggtgaggaattaggccgtctaactagggatacaaggaatgcatagagcaagtcttctcagaaaggagagccacaagaccaggagctgatacaaatttcctataggtggaaaactatagaattgccctagacaaagtgataggtatattaggaaagaactaggtgttaggatgtggccctccgtgtaacgttgtatgggggtgttttttggtctgttgttcacagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374571 - DNA, 1182 bp, Homo sapiens
tggaggggcccgagtttctgcgaagccgcgacctcggcgtccggacgcggggaacaccgggctgagggagtctgcagtcggctccgggaagccgcgcggcgacgggggaggccttcactaaaggggaaaaggaagagggggtcggccagtatccccgaaagagggctagggcgcatgaagaccagcgcagagctccacgagcaggaaaagcccccaagcagccccagggcgactggaccgggccgcttaggccacgcccggggaagagggcctgacgcgctgcggggcggggccgcggggccgggtcgcgcgagcagcggagcaccaagggaacggaaaatggcgcctcacggcccgggtagtcttacgaccctggtgccctgggctgccgccctgctcctcgctctgggcgtggaaagggctctggcgctacccgagatatgcacccaatgtccagggagcgtgcaaaatttgtcaaaagtggccttttattgtaaaacgacacgagagctaatgctgcatgcccgttgctgcctgaatcagaagggcaccatcttggggctggatctccagaactgttctctggaggaccctggtccaaactttcatcaggcacataccactgtcatcatagacctgcaagcaaaccccctcaaaggtgacttggccaacaccttccgtggctttactcagctccagactctgatactgccacaacatgtcaactgtcctggaggaattaatgcctggaatactatcacctcttatatagacaaccaaatctgtcaagggccttgtgtacctgatggtccaggtcttttgcagtgtgtttgtgctgatggtttccatggatacaagtgtatgcgccagggctcgttctcactgcttatgttcttcgggattctgggagccaccactctatccgtctccattctgctttgggcgacccagcgccgaaaagccaagacttcatgaactacataggtcttaccattgacctaagatcaatctgaactatcttagcccagtcagggagctctgcttcctagaaaggcatctttcgccagtggattcgcctcaaggttgaggccgccattggaagatgaaaaattgcactcccttggtgtagacaaataccagttcccattggtgttgttgcctataataaacactttttctttt

SEQ ID NO: 374572 - DNA, 1080 bp, Homo sapiens
aaccctcttctgtattatttctaaagcttaatattatctttactgtttagaaactaatacaatctgtaagaccattaatatgataataatttgtcaaagagcatatatattcattatcatcacactattttttaaaatgttcaactgtatttcatttcagtgatgagtcctgtgagggattattatctttctgtatattcagttaagattttgtatctgatttaatccactgatttttgcaggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374573 - DNA, 2138 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374574 - DNA, 1341 bp, Homo sapiens
  misc_feature (1195)..(1195): n is a, c, g, or t
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggtcaacaaactcagaaaaccacggagaaaccagccctgcagtggtctgtaactccgntgtgaagaatcctgggtgagaacggaataatggacagggagaattctaggttgagaaaaaagctgaaacacaggttgggaattctgggaggctccgaaataggtaggggaattggcaaattttggttcctttgtcaaaatggggtg

SEQ ID NO: 374575 - DNA, 1189 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgcc

SEQ ID NO: 374576 - DNA, 1976 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374577 - DNA, 2114 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacgatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374578 - DNA, 2276 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatatcaacacagttacaccaagttgctgacctctttatgactgctgtagaaagtaaacttctttcactatatggatatttgccggtaaggaaggaaaagtaacagagattagagaaggcaacagaaaagggggagtaaaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374579 - DNA, 1922 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaa

SEQ ID NO: 374580 - DNA, 440 bp, Homo sapiens
gcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggtacttgaatgaataaaaagcttggagagagttttgtaaggcctgtagtactacattgataacatatagaccatctcaaaacaatctctgccgaaataatctttccttgtagcatgaagaaattatattctttattttcttttttcccttcaagttttcagagaactgttacaccacatagaaaaatcagctgggggtgcaggatattctgttctactactttatgtgtatatgaattcactttgttacgacttactttaatctccgattctttg

SEQ ID NO: 374581 - DNA, 1221 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgacccttcaaaaaatcagaaaccaacggagaaaacaagccctgagttggttctggaacttccggtggtcaaggatcctggcttaaggaaccagaaataaattgaacacggaacaattttctagcggttagaagaccg

SEQ ID NO: 374582 - DNA, 2279 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaaaaaaaaaaaaaaaaaaaaaaaaaaaaaaaaggggggggggggaaaaaaatccccagggggcccccaagtagcgcgcgacacagctcttctgggacaaagggggcacataagggggcgcataataaaagaagagacggggcggagtaaacaggcggcagtgggaacagcggcagcggggaactgggaaagaaacactaccgggggggcatacgggacacacccacagagatataacgcgaggaacaacacttcagggtaaggtgataaccaccgatatggccgggaagtgctcgacgtatgaat

SEQ ID NO: 374583 - DNA, 2494 bp, Homo sapiens
ccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaaatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcctgcgttgtttgtaggcaaatgatggtggcatctggcaatcaattagtagaatgtcaggagtgccataatctctaccaccgagattgtcataaaccccaggtgacagacaaggaagcgaatgaccctcgcctggtgtggtattgtgcccgatgtaccagacaaatgaaaagaatggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaatttctattgtttcttaccttaaaatgctaaatattatataacaaaacttggaaactttcattttaaatcaatcttcaacatttttattctaatgatttccatagtgtgtgaaaacaatgattagaatgactggttctcaatgagatcttcagaagattgaaagcatctgtgaatttaaggaaaaagaaatagttcatcttctagcaaagccccaagagttgatcctgatgaatgaggtgccttatgtggcggcagggacgacccaacatagttttctattttcctccccgtattctgggtgttcattttctgtgctagccccatttcaactgactctccctctccctcccaattatttcatctttttcaaaattattttttcattattgatttctcatatcaatggattttcctaattgatttatcatacttcatattatatctttaccttttttatcacctcatttcaattatttaagggtatatctttttccaataaattgtgaactctcctggtg

SEQ ID NO: 374584 - DNA, 512 bp, Homo sapiens
agctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctca

SEQ ID NO: 374585 - DNA, 2378 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaaccta

SEQ ID NO: 374586 - DNA, 1757 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaaccta

SEQ ID NO: 374587 - DNA, 4642 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagaaaaaaaaaaaaaaaaaaaaaaaagaggaaacaaaacgaaactaaagttattcccatagcagagaggaccaaagactataaaacggtccccaccttttttgtttcacatgtggttccctcatcattgaagtcgtatttataaaccctaggcattggaccgatgcgtgtccacaagctggctgaacttgggaaaactgagacctgggggcatccttggttgaaaggaccctcacttctgagagagttgacatattgtgcgacaataattaacctaacagcaatttacgggcgctcatagggctaaattatacaccaactgtctaccgttgttatatagtgttgttaaacagattacgccggcgattattgaatagcatgctagacagagtatatgggctaacatcgaaccttgattacatgcaacgtttttcttacccaaggaccttagtgataaaatgagtgatacaataaaaaaattttatacagcacagcgactcaataactacaacaagcgaccaacaacacacaatgataaaaaacgacatacacaggcaaagcgaaccgctacaggacagtacacaaggtgtaaggtatgagcaatagaagatacgtaataggaggacctaataggaatctgaatacgaagagaaacggcacagcagagacactcgacatagcgcacaagcactacaactcaaactcaagagacacagcactgcaagcaccagacaaccagaaatcagaagcgcaaagacgaaaggctggtcaagacacgagaaaccaggagtagatgaccacaagcccagcacagacgacacgcgtaagagcaacgccaaccaggacgcagagataagataccagaggagccttaaaacaccgaactaccagtcacttaagctgcaatacgccgcagacgagtccggaactatgaccagacagccaaaggacacgccacgcagg

SEQ ID NO: 374588 - DNA, 4592 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctctatgtgttataaacttaatgatttatcatctttaaaaaaagaaatccaagtattttccttgaacaattgtagcaactctggctaggagaaacaaaaatcaaagaactggagccatttgcaagtacattggttagaagtggaatagccgtaactttccattttatctcggcacttagggtttttaaaaatacagttaagttagatattcctgacttagcaaaagaatctccacagcagcttttcttttttttttttttaagtagacatgggatctcgctatattgcccaggctgtttttgaactcttggcctcaagcagtcctcctgcctaagcctcctaagtagctgggattacaggcataagtcactacacctggcttcttaaccttttctttatcacctccctgaagaacttttttagatttttttcttagtcaccccttccccatgatatttcaacaccagatatatactatgtatctgtttatggactgtaaatgttttttgctttatacaaaatagaatttttttttgtccc

SEQ ID NO: 374589 - DNA, 3997 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctc

SEQ ID NO: 374590 - DNA, 4534 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctctatgtgttataaacttaatgatttatcatctttaaaaaaagaaatccaagtattttccttgaacaattgtagcaactctggctaggagaaacaaaaatcaaagaactggagccatttgcaagtacattggttagaagtggaatagccgtaactttccattttatctcggcacttagggtttttaaaaatacagttaagttagatattcctgacttagcaaaagaatctccacagcagcttttcttttttttttttttaagtagacatgggatctcgctatattgcccaggctgtttttgaactcttggcctcaagcagtcctcctgcctaagcctcctaagtagctgggattacaggcataagtcactacacctggcttcttaaccttttctttatcacctccctgaagaacttttttagatttttttcttagtcaccccttccccatgatatttcaacaccagatatatactatgtatctgtttatggactgtaaatgttttttgctttatacaaaatagaatttttttttgtccc

SEQ ID NO: 374591 - DNA, 969 bp, Homo sapiens
acagcttttttttttaattctttttctaagatggaattgggctctgtctcccaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctc

SEQ ID NO: 374592 - DNA, 529 bp, Homo sapiens
agattttcttgagaatgtgataaattattttattaagaaaattatcagctttcttctttaaagtccttcctcttttacctaatgtttataaagactgatattgattttaaaagtcacttgcccctgaatctaagaaagtggtatttatatctgtcatttcttttttgtctgagtagaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtc

SEQ ID NO: 374593 - DNA, 4055 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctc

SEQ ID NO: 374594 - DNA, 4160 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctcaaaaaaaaaataaaaaattgtcgggccccggccccaaaattttaaaaccctccggggccggccccgggggaccaggcccgggccaggacaccggccaacaaggcg

SEQ ID NO: 374595 - DNA, 4018 bp, Homo sapiens
  misc_feature (3869)..(3869): n is a, c, g, or t
  misc_feature (3871)..(3872): n is a, c, g, or t
  misc_feature (3880)..(3880): n is a, c, g, or t
  misc_feature (3882)..(3883): n is a, c, g, or t
  misc_feature (3885)..(3885): n is a, c, g, or t
  misc_feature (3888)..(3888): n is a, c, g, or t
  misc_feature (3897)..(3897): n is a, c, g, or t
  misc_feature (4018)..(4018): n is a, c, g, or t
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttgaaggttttatncnncgtttttngnncnagnttttatgtnctgcccgtttaagattggctttttcggaaaattggcgtggagtacgattatacaatttggttaacaaaaaaaaatgggcgcgagtaatgggggaagaggaggaggcaagagagaaatatgn

SEQ ID NO: 374596 - DNA, 3162 bp, Homo sapiens
gtcgcactccttctccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagcagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtgctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcagccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagcgatttgtgtcctttcttatgaaccttcctgattttttaacttagatttctcactaagtttcctgagttattagtaagattgctccctaaatgtaaccagggatttttccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgactaatgaagctaattaaaagaagcattcaaatctggtttctacctcattaacaattagcagggcactggccagagtttgtaccctgtgttttaccttaacaaattctattgctcttgtattttaacgtgtgtagggaacgtgttcatcaaaactgaccctgagataaggaagagatggggcttgggaattctatcaccaaccttatggtttccgtcaactacacgttgttgcctgtagggtggcccaagtgggtccctgccagaaaacgcatgggccaacaacttggggaaatggccctgtggtggaaacccctttttgggggcgaaaacctctcgtttgcaactcgggtgt

SEQ ID NO: 374597 - DNA, 400 bp, Homo sapiens
gagatggtgtcttgctctggcacccaggctggagtgggggggtgcgatctcagctcactgcaccgtccgaggaggagctgtagtttaaaggaagatactcaatactctaggaagcagatcatcaaaattttaaaaagcggctgggtgcggtggctcatgccttaggttttctagtttagaagacattttgtgtacccttctaggcctctgagcaagaagtttcttcattaggctctccgtgttactttatactttttacttacgttcacagtggtcctaaaaccaagatgcagccctaagcacctcataggagaagctgtattttttttttttttttttgagatggagtcttgctctggcacccaggctggagtgcagtggtgcgatctcagctcactgc

SEQ ID NO: 374598 - DNA, 6473 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374599 - DNA, 6537 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctgctcaggtgatcctcccgcctaggcctgggattacaggcgtgagccactgggtccggcctgctttttttttttttttttttttttttttggagacggagtctcactctgtcacccaggctggagtgtagtggcatgacctcagctcactgcaacctccacctcccgggttcaagcaatgcccctgcctcagcttcctgagtagctgggactataggcacgcgccaccacgcccagctaact

SEQ ID NO: 374600 - DNA, 6610 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctgctgacctcaagtgatctgcccacctccgccccccaaagtgctgggattacaggcatgagccaccgtgtccagccttaggttttctagtttagaagacattttgtgtacccttctaggcctctgagcaagaagtttcttcattaggctctccgtgttactttatactttttacttacgttcacagtggtcctaaaaccaagatgcagccctaagcacctcataggagaagctgtattttttttttttttttttgagatggagtcttgctctggcacccaggctggagtgcagtggtgcgatctcagctcactgc

SEQ ID NO: 374601 - DNA, 6413 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggcctctgagcaagaagtttcttcattaggctctccgtgttactttatactttttacttacgttcacagtggtcctaaaaccaagatgcagccctaagcacctcataggagaagctgtattttttttttttttttttgagatggagtcttgctctggcacccaggctggagtgcagtggtgcgatctcagctcactgc

SEQ ID NO: 374602 - DNA, 5639 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttata

SEQ ID NO: 374603 - DNA, 6592 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374604 - DNA, 5331 bp, Homo sapiens
attcttccatgtttacaccttaagtcctttattatcccttttattgtttcctcatgcagaacttattgagcatagcctattatactgagatacaaaatcaaacttttagaataagctgtctgtgaattagaacactgagcaatctctaccttcccctccaccacctccacccgccaagaaaagctctgtttgcctgaaattagtaagcgtttattggtgtgaagagtttttggtttgggatttttattttatctttttttagctggagagaagaaattttaacttgagctaatagtttgttaatttggttttaggagggaaatgatgcccctgctgtccctgatcttctctgccctcttcatcctcttcggcactgtcatcgttcaggctttcaggtaaatgtcctgtggcttctcggtgcaccaccatggttggtgttgacactttttttgtaaaactccttttttcttactttagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374605 - DNA, 4578 bp, Homo sapiens
acggctttccccctatcctgacagcatcttaactcctcaatatttctccacagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374606 - DNA, 2417 bp, Homo sapiens
tagatagtagtagagagagagagtagagagtagagagagagagtagagagagagagatatagagagagagatagagagagatatagagagatagactcatcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374607 - DNA, 4120 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaatccagggcactttagcaccaaattgtcagatgtgccagcctgtcctagtggtcagagaagatttccctaagatgtaacatttcagctgagacctgaaggatgagcacagtttagccaggcgtctgggatagactgggtcactttacagaagcacagaatatggaagagtgactgtccctactaaagcattccacacagggtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggaaaggatcacccatggctgccattctgggcagcagagcctgggactgtctcttcatcagggaacctctggtgcccagcacagggcctgacacacgtggagtccagtgtatagatgtaaaaggaatgagtgaattaacctcaagagggatacccactcccacctactgatgagaccatgagcccctgaaggacagaaccacatctcattcgtgtttgtgattcctggcacccaacacagcacctgacaaatgacagcctttgatgggtgttggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacataaagatcatacggtggtgaaacttcgacaagatcacagcccatcacgttcaggccttgacaacccctgatgatctccagagcctattcaagatcaagactgagttgtccacagtggtaatcatttacagtgaaaagcacccagtagagcttttcccagcccacgccaccctttgacttggaattggctttccctccataaacatttgttgactgccaggcacactggcaggcctcccagagaaacagataatgcgtacacagtccctgctcctcagggctgcatggtgtggtgatggagacaaggaaaccaatcgtttcaatgtcatgcaccaagggcttcaaggaaagcaagcccagaatggtatcagcataggtaatagcctggagaggtgaaaagcccagaaggttgctaagcagagggatgaggaatgtgtttcagaaatccctcatgagaagagaggatggttacagccatttcaagagagagagttatggccaccctcctttaagatcttagaggatgtaaggaagaaggttgagaagtacccatctagtaaactataatttccaatatctacttcaaccttttgggtgtcctccaagggcagtaccttgtaaaacacaaggaataaatgttttgtgagtg

SEQ ID NO: 374608 - DNA, 448 bp, Homo sapiens
tgtatgtttagtagagacagtgtttcaccatgttggtaaggctggtctcgaactcctgacctcaggtgatccacccacctcagcctcccaaagtgctgggattacaggcgtgtgccaccatgcccggccacttccctttttttatattggctgactgaccctttcccactggctaggaaaggatcacccatggctgccattctgggcagcagagcctgggactgtctcttcatcagggaacctctggtgcccagcacagggcctgacacacgtggagtccagtgtatagatgtaaaaggaatgagtgaattaacctcaagagggatacccactcccacctactgatgagaccatgagcccctgaaggacagaaccacatctcattcgtgtttgtgattcctggcacccaacacagcacctgacaaatgacagcctttgatgggtgttg

SEQ ID NO: 374609 - DNA, 596 bp, Homo sapiens
tgtatgtgtgtgagagagagagaggcaggcacactgaaattgcacgcttttctctttggtcttgtggggcttcatccatacagcaagatgctggctgtgacctttccaatccagacatctgagccattgcgacagggacctcttttcccacttcacttcgtgttttgttggttctgaacagaaaagcttgaactcagtgttattccctgagccctttcagttactgttctctagcccttgtgtattttccagaagagcaatgttaagttccaccgagcaagcgatgggggaatgggtgattgaagtgtcgcagctgctggagaggcactggctcccacagaaggccttctttttctctgtgttcaggccccatccaacacaaagcgttttcctattattttaagtctcactggggtatttattttctcagcaattaaatgtgtcaggaaatgccctgagtcctcaattctcttcttcctacaggagcagctgcctacacttctccttcctgagtctagataaacacagagaatggctagaatacttactagaatttgctcaagatgcagctccaatcccaaaccaatatgataagc

SEQ ID NO: 374610 - DNA, 6515 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggcctgggattacaggcgtgagccactgggtccggcctgctttttttttttttttttttttttttttggagacggagtctcactctgtcacccaggctggagtgtagtggcatgacctcagctcactgcaacctccacctcccgggttcaagcaatgcccctgcctcagcttcctgagtagctgggactataggcacgcgccaccacgcccagctaact

SEQ ID NO: 374611 - DNA, 6487 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggtccggcctgctttttttttttttttttttttttttttggagacggagtctcactctgtcacccaggctggagtgtagtggcatgacctcagctcactgcaacctccacctcccgggttcaagcaatgcccctgcctcagcttcctgagtagctgggactataggcacgcgccaccacgcccagctaact

SEQ ID NO: 374612 - DNA, 6442 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagatcatcaaaattttaaaaagcggctgggcgcggtggctcatgcctgcaatcccagcactttaaggaggctgaggcgggcggatcaccttaggtcaggagttcaagaccagcctggccaatgtggtgaaaccctgtctctactaaaaatacaaaaattagccaggcgtggtggcaggcacctgtaatcccaggtactcaggaggct

SEQ ID NO: 374613 - DNA, 5357 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttcca

SEQ ID NO: 374614 - DNA, 6419 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacaggtattttcaggactcaaactaccacaatgaacagagtatagattttagattgctcttctagaaccatggctagaagaatctttcctttgtcctgttctaacctaggaatgaaaaacaccaccagtttgaatcgcctagatgaaaatcttttcctctgggtgttatttttccccactgaatgccacaccattgaaaatagactgctcatcccctcttcctttcttgtccttgtcccatgctcaccccaccctcctgtcctgtgtcttggagaagcacagggctccaccctgcaagcggcatctggcggaccctcatgagcctgtcgtgcaggccaggtcattggccccttccccaatcccggccctgctgtgctgctgccatggcgcatgctcctaactctgaacaacccacggcagcttctagccccgcatctggaaaaaggcccctttccaagcaatctcacgtttactggttgttctgggagtaagtggctaaatgtatattttgggggtatcccccaacaacagtttgttggccacaggttgaaaaggaaaggaataaacgggagttctgcatgtgagttctcaagaaaaggaaagggaggctgagcagtggctgaagcgatgcagccttgagacacgctgtgagcatcccatccgccgccccagcgctgctggtagccaggggaggggtctgcacagcgagaagtactgtgatgactttgagccgttgacatgtatgtcttcagatgcctttctgcctctgtcgattttagggtatggatattaggagccataacttgtaatcttgttctctgaacgtagagataagctgctataaagccagtagatgttaaactgaagagaaattattcccacctgctatgagtcaggcttaaggaatctcttcaatagtgtctctttagtaaaataccaaacatgtctttgtatcaaggaacttaaaatttctcaacaattgtattttgaacactgttaccctaaaagtgctgtctcttcaagtcatcttttgcaggaagtgagccaagatttgttctagactcccattttgcaaaaggcttactttccacttctgggctgtattttgatgtctcatcttcattgttttcactcttaacttagagctgcttcaccagtattggggtcagactggccatcagcacctgagcgtgctgagctccaggtatagtggaccccagggtgcctcataccagccagttagagagcataccttttatttttcagggcagaatgaccagtggttctgagtttgagtttggacagcttcaaagagtggtccgttcaaatgtcaaagcaaggtgcctttggtggctttgtgaagggtgaaaatcagtgatgggacatttactaagtatttcttttttttttttttttttttagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374615 - DNA, 5055 bp, Homo sapiens
acctttaagcgtcacgtgactcccctcgggcttgtcccctcctctttcccctccccaggcccaggcgagcgctggtgtggacgggaagctcccggcccggcgaactaactggagcacggagctgcagccggttgggccggtgtactttcccgctctggaaaggaagagaaatggaagtgagaaagttgagcatttcctggcagttcttgatagttctggttctgatcctgcaaattctgtctgcgttggattttgacccatacagagtcctaggggtcagccgaacagccagtcaggctgatattaaaaaggcttataagaagctcgcccgggaatggcatcctgacaaaaacaaagatcctggagcagaagacaagttcattcaaatcagtaaggcttacgagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtgtaggaattggcgtggtccatgctgggtatgagagacgcctggcccatcacctaggggcacacagcacgccctctatcctaggaatcattaacgggaaaatctccttcttccacaatgcagttgtccgtgaaaatctgcgacaatttgtagaaagtcttcttccagggaacttggtggagaaagttacaaataaaaattacgtcagattcctctctggctggcagcaagagaataagcctcatgtccttctgtttgaccaaacgcccattgtgccactgttatacaagttgactgcctttgcatacaaagattatttatcatttggatatgtatatgtgggtttgagagggacggaagagatgacaaggcggtacaacatcaatatctacgcccctaccctcttggtctttaaagaacatataaacaggcctgccgatgttatccaggcccgaggtatgaagaagcaaatcattgacgacttcatcacccgaaacaaatatctattggcagccaggctcaccagccagaagttgttccatgaactctgccctgtgaaacggtcgcatcgacagaggaagtactgtgtggttttattgactgctgagactaccaagttgagcaaaccctttgaggctttcctgtcctttgccctggcaaacactcaagacacagtgagatttgtgcatgtctacagcaatcggcagcaggagtttgccgacaccttactaccagacagtgaggcgtttcaagggaaatcagcggtgtctattttagaaaggcgcaacacagcaggaagggtggtgtataaaaccctggaagacccttggattgggagtgagagtgacaaatttatcctcttgggctatctcgaccagctgcgtaaagatccagctcttctgtcctctgaagcagtgcttcctgacctgaccgatgaacttgcccctgtttttctccttcgatggttctactctgcttctgactacatctcagactgctgggatagcatttttcacaacaactggagggaaatgatgcccctgctgtccctgatcttctctgccctcttcatcctcttcggcactgtcatcgttcaggctttcagcgactctaatgatgagcgagagtcaagccctccagaaaaagaggaagcccaagagaagactgggaaaactgagccaagcttcaccaaagaaaacagcagcaagattcctaaaaaaggctttgtggaggtaactgaactcacagatgtaacatacaccagtaacttggtacgtctgaggccaggccacatgaatgtggtcctcatcctgtcgaattctaccaagaccagcctactacagaaatttgctttggaggtctacacatttactgggagcagctgcctacacttctccttcctgagtctagataaacacagagaatggctagaatacttactagaatttgctcaagatgcagctccaatcccaaaccaatatgataagcatttcatggagcgtgactacactggttatgtactggctctgaatggccacaagaaatacttctgcctcttcaagccccaaaagacagtcgaagaggaggaagccatagggtcgtgcagtgatgttgactcttccctctacctgggtgaatctcgagggaaaccttcctgtggccttggatccaggcccatcaaaggaaagttgagcaagctctctttatggatggaacgcctgctggagggctccttacagaggttttatatcccatcatggcctgaactagactgagaggattttccaaagagatttgaactcttcagactttttaacatgcccctgtgaacagttgttgagacagagtttcactcttgttgcccaggctggagtgaaatggtgcgatctcggttcaccgcaacctccacatcccaggttcaagtgattctcctgcctcagcctcctgagtagctaggattacaggcatgtgccaccatgtaattagcccggctaattttgtatttttagtagagacgggatttctccatgttgatcaggctggtcatgaactcctgacctcaggtgatctgcctgcctcagcctcccaaagtgctgctgggattacaggcgtgagccaccactcccggctaagttagtatttctttaatcttaatgctttaaactaagccacttggatcctgaataatttaaatcttgagctacattggtaagtaataaattatttaaggccaggaattcctgtagttttcatggagtctgtagctttattaaaaaataaatcactgccaggcttcattcttccatatgatcctctaaaaatggacacttcctctgaatgctgtatctcatggcacctggtccaactagaaatggtcaaggaattcatttggctccttgatacatcagtcctcaatattactttctaggtattttatggccagattgcttatatgagtggtcttttggtttggtagtaggtttttatttttaatttctgtactaatgaaattcctgactttaatttctgaaaaccaaaaactctccaagtgtatttatttatattttttttaatagagacgaggtcttgctatgttgcccaggctggtcccaaactcctggcctcaagcagtccttccaccttggcctcccaaagtgctgggattatcaatatgagccaccatgccagatttgttcatttttaaacatttttatctcttcaagtcatcttttgatcttttaaaaagcaccttcaaacagctgcaccttccatttgcactaggaaatgaaggtagtgatgggattggcaatgttcctggcagatgtttcagcccaaaagctcttctacagaccggtttagagctggtgccctatgagaatattagggagcttttattttaaattgaactttacccttgtccatgcaaggcattcctcctgaatgcatccatgaatttgtttacttttgcgtcaaacatatgagccattgtcatgctcagcctgtgccaccattgctctgtctgatgtatgtaatcatacaagacctgattttggttctaacacagtggtctttgactatcaacattgatgtttttagagatgggttcttctggttgatacagactatgcattgcgtttagcagatggggtaaaactggcctaaaacaagtctttgcagaatacatgccaatttccaaaaaaaaaaaaaaatttgttgctcaggtgttgcacaatttttatctaacactgaggctatcagctccaactaaacaacatttcagtgggtgaggctgccctaacttccattaggggccatggtctcactgccatcacttattagccatgagaatttggttgtagttttcaggtaggttggtttcttcctcatttgcagcttgttgatacttgttcctttttatttattaacatcccaatcaatttgcagctgccatcattacataaatatttttctgttataaaaagaagtgtgatctgtttttttagtgatttcctttgtttgggaatagagattggaagcacatactcagacctgttttgttaactagaattctttaaaagctgatgccaaacatctttacagaggaactgtagttcacatccacctgtctgacattgtcccctaaaaacaagtgcagtgtggcagctgctgaatctgtctgttcagtttgtcaaggaggataattatgcttgggagagatctgaaaagaaggtgaatattttgcacttttgatactcttaggaacaaataacttatttggcaaattgtttcttttttatgttttgggtgttgtttttgttttttgactttttttgtattgtgaacaggcactgaagctgatgttattttaagattacagaatggaaaaagaaataaactattttaatgtctgataattatggggtagcccttgcattgcaagatgatgatttgattatggacacattatcaacagaattgaatttgcatggaactcaagacacgcttaagatcaccacagcataactgcagatttcaggaattacagtcatagagggtacatcaacttgaagagtagattgagtcttacaggaagtgagttacaataagtaacattaagagcccagctgccagcctggccaacatggtgaaaccccgtctccactaaaaatacaaaaattagccgggcgtggtgacgcatgaccgtaattccagctactcaggaggctgaggcagcagaattgcttgaacccaggaggcggagattgcagtgagctaagatcgggccactgcactccagcctgggggacagag

SEQ ID NO: 374616 - DNA, 446 bp, Homo sapiens
attgatttttttcctattgggaatatgagggtatccacagtcaacgggaaacgaggggaggcccagtcaaccccagcaccccaaggatgattgcttgctcacgggaactgagcagactatgaactcaatagccatagactttggactcccagacaggtgtgacaagcaacagccgggcagatgagggactttacaccagaggccagcagataccacaaagcagatgccttcatgcctgcaggagcccaggggccctctcttcctcaacggccacagaacgaaacagccacactccccatcccccaacatcagatgccatcttagggaaagaagccagagggaggcaaggccatctgagagagtgagcgattatacaagagaagcaattagaatcatcaagtgattacacgagtaaaaatcatcaagtgatttacacaagtgattat

SEQ ID NO: 374617 - DNA, 618 bp, Homo sapiens
gttgccatgagctgagattgtaccactgcactccagcctgggtgacagagcaagactctgtctcaaaaaaaaaaaaaaaaaaaaaaaaaaagtaactgtgtgtgctgtggcagtggcatgggattggtagtggagaagaagcctccaagaagaagaatcaccagggtgtgaggctgcctgtgtgggtgtctggggactctcattccccagggctagacacaggatgagtttctccctctgtgccttggtagaggaagctcattgtgtgaatggattctgtggctaaggcatgactaactgtgccagttcaagaaagtgcagttacggttttttcaggttcagggaacttcacgatatgggaatttccacagggattttggtggccttcggaaacatcagctgggtttggctgtctctttttcatcaggggatgtgtaaagaatttagcttcctatgagaaggctttgtgttcttgttttggtatatccaggcttctaattttattctcccactgttggaagtcactgcatggtgattaagagcagggactcagagtctgtctgcctcttgccagctctgtgaacttgggcaagttaagttctccaagactctgtgaaa

SEQ ID NO: 374618 - DNA, 912 bp, Homo sapiens
gagatcacaccaccgcacctcagcctgggcaacagagcaagaccctgtctcaaaaaaaagggaaaatatgattatttaaattcatctagtcaacccaaactttttctatataatgaaacagcatattgaattttcctctcaaaagtttattcatttttgttattcccccaaatagcattcctttaaggacgatggcatttgcttccttcttccctgctctctcaaatagaggtggttgaaagtccttccagaattccctttcttgtttctcctactactttaggatcaccacagatgatgaagatggaaaagcttctctaaaacatgggctcattgttgaaaatgataggttttactcaaggggactaatcagtaatatgccagcctcatatcagggactggggacattttctgtcattgcagactctctgcatgataagtttttcagttctcaattcaagggaagacctttggttgactgcagtgcgtatgcctgactgtgttatatttcagctgtttctccttttccttctgaccccctttccttcccaaagaccataatgttctttcttagtttaggaaaagagtcacttgaaaatttgatcaagggctcatacttgaattattaactctttcttctgatgccctaaatacttacatttcttgatgtccacaccttttcacaaatgcttatcttattattccttcttacttactcttctgtgaataaagtctgatggatttattttttaccatttttaatgaataaatgatttcaaccattacttttccgtactatttttatgaataaatgatttcaaccattaaaaaaaaaaaacacacgcaaaacaataacaaaacacaaaaaaaaagggggggcgctaaagatcccggggggcaaaaaaacaacca

SEQ ID NO: 374619 - DNA, 175 bp, Homo sapiens
cagatctgaacttttcctttaaaatcagaaaaggtttaattttaatcgtgaaaatattatcatcattgggtaacagctgacactctattctgtttactactagctatttaatgatttgacttctatatgtcattcttcagtattcctaaaattcagtttttatgtatggtattat

SEQ ID NO: 374620 - DNA, 413 bp, Homo sapiens
ttatctctgctatcgaaagcacaaggaggaggaattgcagctggccactagggggagcctcattcacggatcttatggaatcaagtttaggaggaccaagtgtcgccacgtctaggcttcctgggcactttgacaccatccaggcttcttgtgaggaggaggtatcaacagctgtgcccactgggaggctttcagatgcagcatccaccaaggaatacaccgactaacacacatgacagcctgaactagcaacctgcatcaacacccctgcagaaaagcagtgcatttcaactgctcatttaataagtatttgaattcataattacaaaacatcttctgtaattaaaccaccatatggcatttaaaatattttggggggacaaagagtagcaaagaattatattggatattga

SEQ ID NO: 374621 - DNA, 399 bp, Homo sapiens
ttttaagggtcatcgaccggccataccgaacaacccactaccctccttgtcatagtcaactattgagccctgtgtcattcccctcatttctacaagatcccggcacctgggtcatggtcaccctctcccatactacctcagctgtgattctcagtgattttgctttccgtagagaaatccctgcaaagccctggactgcccattccatgacctcctcttttctggggattgttttcctccatcctaactcatccactctcccttatagtcatgcccaagacctttttacacaagtaactgcactctgttatctcaattctaagaatcctactttccaaccaccacttctcattttcagtttgccaattccaaaaattattgacccctctataaactaaa

SEQ ID NO: 374622 - DNA, 2292 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374623 - DNA, 1042 bp, Homo sapiens
acggagaggcatggcttcaccccgagcctaggcgcacaaagggcgtggtctggcagggttgggggcgtggccgcacagaaactggcggcaagggtcgtggccctggatcctgctgcgagaaggggcgcgatttcttctggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374624 - DNA, 2568 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374625 - DNA, 2100 bp, Homo sapiens
  misc_feature (1)..(1): n is a, c, g, or t
naaccttacggctaggtacgaggctgggtgttggtcgcgcccaagtctgggaagtgccctttctctcttaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374626 - DNA, 2451 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggtaaggaagggcccccgcctggggcagtgggcaccatccatcaggacgccttcacacccacctgctcttggtcctcttaggggcctttgggactctgggagttggtgcaggatttgcacttggggccaagctgtgccggccagatgctgaggtgaggcactggagttgggagacttgctgctctctaggtcctgatccaccctaaccatcctgggtcccctcccgactaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374627 - DNA, 2366 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtgaatagcgtcgggggtcgagctggtgtgggagaaccacatcctgatgcgatgtgacctcgacccagcctggcccggggtcggggatcaggctcgggcccgtgcgctctttaagggagaggcgtgggttgcgtggagggtcgcgcccgctaacccgggggcgtgacctcgtgcctcttggtgacgtaacatggggcgggctcactactggggctgagatttggggtccggttgtggaaagagaggcggggcttccgcctgtccattgacaagtaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaagggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374628 - DNA, 1978 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374629 - DNA, 1228 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaaggccctccactaacttcagcacgaaggaacccacatctccctgcacagcctcctggggcttccagaagatgtctg

SEQ ID NO: 374630 - DNA, 544 bp, Homo sapiens
gtgagggcattgcagagagggctggggactggttggactgtgggctagagtgtctgtgagggtaggggtttttcagaggtggaagaatggccaagagagtgggcatggctgtgatgggctctgtgttccagggacggtgggcgtggcggcagtgacagcaggccctggcctcaccaacacggtgactgcggtgaagaatgctcagatggctcagtccccaatcctgcttctgggtggggctgccagcactctgctgcaggtacccagtccttgggggccagtgggggcctaggggggcttgaagggctcatgcgataaccctgccacacctctgtctttgccagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtaggtggaggatggtgatgctgagcagtgctggggccgaggggctggggacatcctcgtg

SEQ ID NO: 374631 - DNA, 528 bp, Homo sapiens
aggatactggagggcagggaggagtcacagcagatggctccctgccatctgctctgcgtgcgttgtgcccctggccaaaccccctgggttatataaccctctcctctctccctgattgccctgccatcctggagacaggcagtgtaacagtggggcacttaagagcgtgggttctattgaactttcagtcttacttgggcaagccttgatgtcctcagctgtaagagggatgtaatgacaagaggatctgataagatgttatgccttggtttgagcctggcatgtagtataatatatgcctaaccaagaccaagcttctcttgacctctcaccctgctcctgcccccttacctggggcagggggattgccccctttcccagctgccctctgccctggcctttaactttattgctccacctgtccttgggcccagggtggacaaggcaagcgtccggcatggcggagagaacgtggccgctgtgctgagggcccatggtgtgcggttcatcttcacgctggtcggtggg

SEQ ID NO: 374632 - DNA, 2246 bp, Homo sapiens
  misc_feature (20)..(20): n is a, c, g, or t
  misc_feature (22)..(22): n is a, c, g, or t
taggcaagtacgaggccggngntgatcggccgaggattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374633 - DNA, 1149 bp, Homo sapiens
acggagaggcatggcttcaccccgagcctaggcgcacaaagggcgtggtctggcagggttgggggcgtggccgcacagaaactggcggcaagggtcgtggccctggatcctgctgcgagaaggggcgcgatttcttctggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagatactggcaactctttgaggagctggagctcaggccgaggacgtggcctggattccccagttccgccgaggcacacagggggagacgacgcggcaaggccgagggcgaggaacgcggcccaatcggcaatcgtggggacggtccgctaggggacaggagaaacccacggacaggcaagactcagcatcctcaccaaatggataacactgggcgggggcggaggg

SEQ ID NO: 374634 - DNA, 2363 bp, Homo sapiens
acggagaggcatggcttcaccccgagcctaggcgcacaaagggcgtggtctggcagggttgggggcgtggccgcacagaaactggcggcaagggtcgtggccctggatcctgctgcgagaaggggcgcgatttcttctggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374635 - DNA, 2323 bp, Homo sapiens
  misc_feature (5)..(5): n is a, c, g, or t
  misc_feature (2312)..(2312): n is a, c, g, or t
  misc_feature (2317)..(2317): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagtaaaaaaaaaaaagggaggagngaaanaaaaaa

SEQ ID NO: 374636 - DNA, 2108 bp, Homo sapiens
  misc_feature (1)..(1): n is a, c, g, or t
ngttacggactaagtagacctgggattaagaagcgccaaatcatggcaagtgcctttctctacatagagtgagacaatagtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374637 - DNA, 2429 bp, Homo sapiens
  misc_feature (5)..(5): n is a, c, g, or t
ggacnagcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtggacaaggcaagcgtccggcatggcggagagaacgtggccgctgtgctgagggcccatggtgtgcggttcatcttcacgctggtcggtgggcacatttccccgctgctggtggcctgtgagaaactgggcatccgtgtggtggacacacgccatgaggtcacggccgtctttgctgctgatgctatggcccgcctgtccgggacggtgggcgtggcggcagtgacagcaggccctggcctcaccaacacggtgactgcggtgaagaatgctcagatggctcagtccccaatcctgcttctgggtggggctgccagcactctgctgcagaaccggggtgcgctccaggctgttgatcagctgtcccttttccggccactctgtaagttttgtgtgtctgtgcggagggtgcgggacattgtgcccaccctgagggccgcgatggctgccgcccagtcgggcaccccaggtccggtgtttgtggagctgcccgttgacgtgctgtacccctacttcatggtccagaaggagatggtgccagccaagccacccaagggcctcgtgggccgagtggtctcctggtatttagagaattacctggccaacctctttgcaggagcctgggagcctcagcccgagggaccgctgcccctggacatcccccaggcttccccgcagcaggttcagcgctgtgtggagatcctgagccgggccaagaggcctctgatggtgctggggagtcaggccctgctcaccccaacgtctgccgacaagcttcgggctgccgtggagaccttgggtgttccctgcttccttggagggatggcacgggggctgttaggccgcaaccaccccctccacatccgggagaaccgcagtgcggccctgaagaaggcggatgtcattgtcctagcaggaactgtgtgtgacttccgcctatcctatggccgtgtcctcagccacagcagcaagatcatcatcgtcaatcgtaatcgggaagagatgttgctcaactcagacatcttctggaagccccaggaggctgtgcagggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagtacaaaaaaaaaaagggggggcccccggagatctagaacgaggagagcttctcgagattaatccaccttgggggtcgcatggcagcccgcgatatggagagcagacagttgcggagggtgtcaccaaagcaggggccac

SEQ ID NO: 374638 - DNA, 1902 bp, Homo sapiens
ctgcctcggcctctcaaaagtgctgggattacagaccagagctactgcgcccggcctgatagatgcttctgtaggaacaaatggtggggtggacacagagggaggcttgaaaacgtgcatgtgatcacgttccctcccacactgcccactgccctcaggacagagagcacactcgttggccccttagcctgtcttcctgccgtatctctcccctccccttattttagtccccttggacttgaacttggttcatcattctgaggatgttgactcccctgcagcctaggcgacaggacactcttgtattaagcagagaagtagcaccgttgcatctgtgttgggaaggtccactcagcagccatggacggcaggccggaagggggctgggtggaggccaggggggctgctcaaaatggccaggacagaagcgaggaggcctgaactggagatgaacagcggcagagcctcaccttctcagagcctccatttgatcatttgaaaaatggggtggtgaaagatacatcacggggctgtttgttagttcacttcagtaacgttcgctgtgcgcttccacgtgcctggatttgagagatgtgcttggtggatgtagctcttttcattgagtgtttcccaggcagaaggaggtggagggaggggacgaggccagcttgggtttgtcacctgccttgtgctccttaacccttgtttcttgggccttgtcttcccttttcacctgggctgccctcccctggttctggcaggttctggggtgtttcacctgttttttttctaggagcacccctggcctgcttcccgtctgcctgctcggatgctgctgctggcttcctgctgttttgaggcctctgatgctggaagaacaggaggaagccagctccccacagctgtgtcctcttccttccccaggagatgtgggttccttcgtgctgaagttagtggagggccttcagggccagacctgggccccagactgggtggaggagctgcgggaagccgaccggcagaaggagcagacctttcgggagaaggcagcgatgcctgtggcccagcacctgaacccagtgcaggtgctgcagctggtggaggaaacgctacctgacaactcaattctggtggtggatggcggggacttcgtgggcactgctgcccatctggtacagccccgcggccccctgcgctggctcgatcctggggcctttgggactctgggagttggtgcaggatttgcacttggggccaagctgtgccggccagatgctgaggtctggtgcctgtttggggacggagcttttggctacagcctcatcgaatttgatacattcgtcagacacaagatcccagtgatggccttggtagggaatgatgctggctggacacagatttctcgggagcaggtgccctctctgggcagcaacgtggcctgtggcctggcctacactgattatcacaaggcagccatgggtctgggggcccggggcttgctgctctcacgggagaacgaggatcaggtggtcaaggtgctgcacgatgcccagcagcagtgccgagacggccacccggttgtggtcaacatcctcattgggaggacggacttccgcgatggctccattgctgtatagggccttgtgggtcaggacgcttggctgccttcctgcccctggactgtgtccagctggtttggagtctcatcattgcttgccctgggcctatcccatgaggcccagtgactccacaacctccctgaggaggggatggaggggtcaaatctcagagaggctctcttgtgagctcttggaccctcctcttcacggacccaactgtgccgtttgtcccctctcttatggagactgaataaaccacctctggcccatgtaggcccaagta

SEQ ID NO: 374639 - DNA, 402 bp, Homo sapiens
tcatggtgtgtcactttcaaggaaaggggacctaggctgcacctctctccatgggaggcatgtcaaggtgaccttgtacaaatggatgtagggtgggagatattatggccatctgggaaaatataacctgcctctgccctatcctgttggccaaagcatgtcatgaggccagtcccgattcagggggtgtggggagctgcaaggtcactgtaggtggcacaggtgcagggagactcggtgaggaacagggactcatttgcatccagtccaccacagtggatcaagtaaggtagacgacatggggcctctgcctactgcattcctgtcccccacaccaggaactgtgtgtgacttccgcctatcctatggccgtgtcctcagccacagcagcaagatcatcat

SEQ ID NO: 374640 - DNA, 646 bp, Homo sapiens
tggtgaagctgtggccagctcagccacgtgacaccttgtacttgcttccctccttgcctgcctcgcttccattttccttccctctgttggccttgggagtgtgcctcgtagggtctcagaaaacaataccccgaaatgaaggcctccctcggaagcaaacatttctctctgaccttctcctgccctcctgtctctggtcccttattctcccccaaggctagctataaaaactacaatccctcttcaccaaaagcctgccctaaaacctaaaaatattactctaactttcctctttctttctgtgtaaaattggccataggaaattatttgacctttgtctgattgtaggtcagaagacccccatccagagagagtcctgcgccatatgaggaaggaaggaatgctgcgcagagaggccgaaaagaatcttgacagacaggcctcgctgggttccccactcagtctatcagcattagatcaggctcttttgtccaaccgtatttctacacggccatccatactttgttgaactgaagcctaaaaatggacagtttctcctgtatctttgggtgttcattctgaaggttcttgtatctcataaaaccatggtcaaataaatttgtgtatttgtttgccttttctccta

SEQ ID NO: 374641 - DNA, 2541 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttca

SEQ ID NO: 374642 - DNA, 771 bp, Homo sapiens
aaaaatcctgatgatttacctgtttaccctataaaggtatactttcatgatctaaagttgacaataatgacaataatatgtgtcatttcagggccattgattgttttaattaccttctctttatgaaaaacatgaccagttaattatagctccaaataccccacaccagacccacaacaacacagatgcacacgggtgcacacacatacacacacacaggcacatatttcccccgtctagttctgtattctactgttaagtccttattgagaatacttaaaatactcactgtgaagagtgctttggaaaatcttaaatggataatcataaagggatattgttttcagggtgtagcttccaatagaaaaaattgggggtttggtatttcaatgatactttgggtgtataatcgggagaggcccctttatgatagggttcccatagttcctgtaaaaacaagggtagtgatgaatctatttgcctctcttataaataactgctcgtttttctttctgtttttctccttgaagacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccaccttcttcaaagagacccgattctgtcgtccaaaatggccggaaagttgcctttaactcagactgagcctaataccggtggtttctgtggc

SEQ ID NO: 374643 - DNA, 478 bp, Homo sapiens
  misc_feature (41)..(43): n is a, c, g, or t
  misc_feature (47)..(47): n is a, c, g, or t
  misc_feature (49)..(49): n is a, c, g, or t
  misc_feature (54)..(54): n is a, c, g, or t
  misc_feature (56)..(57): n is a, c, g, or t
  misc_feature (61)..(61): n is a, c, g, or t
  misc_feature (70)..(70): n is a, c, g, or t
  misc_feature (76)..(76): n is a, c, g, or t
  misc_feature (80)..(80): n is a, c, g, or t
  misc_feature (99)..(99): n is a, c, g, or t
  misc_feature (109)..(109): n is a, c, g, or t
  misc_feature (112)..(112): n is a, c, g, or t
  misc_feature (248)..(248): n is a, c, g, or t
ggtgatccgcccgcctagcctcccaaagtgttgggattacnnncgtnanccacngnncccngcctctttngggttntagntccaactctctgcttcatntgactcatgnttncacctcctttgtccacttgggttttaaattgtaagtctggaagttactagaacaatcccagaattagctcacacactttcactctgtttttccctttcttcctggggttatgttttacccagcattcctaggtgtntgtggtgggagattccgcccctacgttatcttaatttgttgccatatttctgaaccaggaatcccatttaccacattgagttctggacatcaaggttctccgggcatcactttctatgctgtgtcatcagtgaagcccataaacttacccgttatcagaaaagcgaagatttcgagatcttgttgagacggtaggtatatagtatgtcctgaggggtttagaaaaaatag

SEQ ID NO: 374644 - DNA, 6755 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374645 - DNA, 2421 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttca

SEQ ID NO: 374646 - DNA, 5860 bp, Homo sapiens
caccaggcccggctaatttttttgtattttttagtagagatggggtttcatcatgttagccaggatggtctagatctccttacctcatgatccgtccgcctcagcctcccaaagcgttgggattacaggcatgagccaccgcgctggctatctggctgttctttaggcttcctctttgtctttgaaattctggagcctcagtcctgtgtgcatggattcatttttaatttattctgcttagaacttggtattctttacacggagaattcatgacttttacaattctggaatcccatttaccacattgagttctggacatcaaggttctccgggcatcactttctatgctgtgtcatcagtgaagcccataaacttacccgttatcagaaaagcgaagatttcgagatcttgttgagacagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374647 - DNA, 5726 bp, Homo sapiens
ttcccaaggtttggtcggctgccaaagcttacagactgccagccacccggccgagcatttgccaaggtgatgtaaaatattcacgggaacacgccgtctcgatgttctactcacaactggttctctccctagctcccgaggaaaagtaacatgaggcccatgtggctgctttctcttctcagcagaaggtgctgatgttattagtggcttgccaagctatggttggagggggatgtcaggggcacgctgtggggctgacctttctgtctctgactctgttttgtagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374648 - DNA, 2032 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggtaagcaacagttgggatgagatgtggaagattcattcattcattcattccacaactatttcttaagtgcctcctaacttgggaggatgccatctctcgtcgtgtggattcaatttgctttcgtatcttgctggttctttttgcaagtctcaaaattaagtctctaactcttcagggaccatc

SEQ ID NO: 374649 - DNA, 5224 bp, Homo sapiens
aacaaaggaacatgtgtattctgtaattgtgtagggataatagttccaagccttctctgtcacataaaatattttggggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374650 - DNA, 5361 bp, Homo sapiens
  misc_feature (79)..(79): n is a, c, g, or t
gacctgaggatcccaacataagcacatggcatgtgatagggacggtgacgcctgccgttccggagccggcagagcaggntggagctggcgtgtggaaaaagcagcgggctgccatgtgtccgagccgagcactggtctacgcgctgacgttcgagaaccccctcgtctgccacccccatgccttgctagtgtacccaaccctgccagagtgcctgcagcggcagtgggacccaggtagagcaggacctgggcgatgaagctgatcaccccccagggcccatgaggaagttgctgaggacactttttgaggatgctggatacttaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374651 - DNA, 5217 bp, Homo sapiens
aaaaatcctgatgatttacctgtttaccctataaaggtatactttcatgatctaaagttgacaataatgacaataatatgtgtcatttcagggccattgattgttttaattaccttctctttatgaaaaacatgaccagttaattatagctccaaataccccacaccagacccacaacaacacagatgcacacgggtgcacacacatacacacacacaggcacatatttcccccgtctagttctgtattctactgttaagtccttattgagaatacttaaaatactcactgtgaagagtgctttggaaaatcttaaatggataatcataaagggatattgttttcagggtgtagcttccaatagaaaaaattgggggtttggtatttcaatgatactttgggtgtataatcgggagaggcccctttatgatagggttcccatagttcctgtaaaaacaagggtagtgatgaatctatttgcctctcttataaataactgctcgtttttctttctgtttttctccttgaagacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374652 - DNA, 1559 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgaggtaagcgccgcgcccggcccggcctcgcccgctccgggacccccgccgctaccgccgcctcctggccggcgagccccgggcgagcggcaggaaacccaggtggacgttaccccgcaaacccgaa

SEQ ID NO: 374653 - DNA, 6875 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374654 - DNA, 5867 bp, Homo sapiens
gtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcataactgagaacatggctgagctcacaggggctgtccgtatttgccatctggaccaagggttaagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374655 - DNA, 5879 bp, Homo sapiens
  misc_feature (41)..(43): n is a, c, g, or t
  misc_feature (47)..(47): n is a, c, g, or t
  misc_feature (49)..(49): n is a, c, g, or t
  misc_feature (54)..(54): n is a, c, g, or t
  misc_feature (56)..(57): n is a, c, g, or t
  misc_feature (61)..(61): n is a, c, g, or t
  misc_feature (70)..(70): n is a, c, g, or t
  misc_feature (76)..(76): n is a, c, g, or t
  misc_feature (80)..(80): n is a, c, g, or t
  misc_feature (99)..(99): n is a, c, g, or t
  misc_feature (109)..(109): n is a, c, g, or t
  misc_feature (112)..(112): n is a, c, g, or t
  misc_feature (248)..(248): n is a, c, g, or t
ggtgatccgcccgcctagcctcccaaagtgttgggattacnnncgtnanccacngnncccngcctctttngggttntagntccaactctctgcttcatntgactcatgnttncacctcctttgtccacttgggttttaaattgtaagtctggaagttactagaacaatcccagaattagctcacacactttcactctgtttttccctttcttcctggggttatgttttacccagcattcctaggtgtntgtggtgggagattccgcccctacgttatcttaatttgttgccatatttctgaaccaggaatcccatttaccacattgagttctggacatcaaggttctccgggcatcactttctatgctgtgtcatcagtgaagcccataaacttacccgttatcagaaaagcgaagatttcgagatcttgttgagacagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctaagcacttcaagtcagagaagacaggacggggacagttgagggaaggctggagagatagtcatcagcctatcatgtgctcctacaagctggtgactgtgaagtttgaggtctgggggcttcagaccagagtggaacaatttgtacacaaggtggtccgagacattctgctgattggacatagacaggcttttgcatgggttgatgagtggtatgatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374656 - DNA, 1893 bp, Homo sapiens
agagccgggccaggcgaggtaacaggctacgtggggttcatgttctctctggttgttccctccccgtttgtacttcatttccattcacacggctgcacttcccagttttccaggatctctcctctgaaaccaggcaagggtttgttcccaaatcccacccattgcctctccagccccagacttgcttactggaccacacataggtggtgggcattggtgacttgtccctagggtcaggggaccagaaacttcccagaggggctggatggagcacggcagcactcagggcacaatggagagcggattcaaagggcaaaggagccgaggaaagcccctctgcccgagcctccccagcgccggccgggctccgctccggagcagccccgccgtctggcagagacatgctgttttgtttaaatcctccacattctttgccatttccccattggccggatggggctaccctccccgccgcggccgctgctgatgtcagcctcgctcgcgctcgctcctcccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagccgagccccggagcggcgcggggaccggccctaaaaagagcaggaaatcttgtttaccgcccgcggagagaagccgatcgagcctttgtctggaaagtcagcatctccggctccggctgcaatgtgttcctggtgacattagcatcgggcagacccgccggaggaggggggtcgccaggttcccgtctgctttcggaggcggatcgagcgggtgacttttgtgcattcgttttaatttttggaaatctctcttttttcctccctcgctcgctgccgggcatgtcctgatctggcggccgctcctaccaccctgggcagccgagcagagtcgtccccagcgggtctccctccctgcctccctgactttgcaacaccgcgttccgggaggaccggcctcggcgagggaggaggcgggggagctgcgaacacccagacccaaaccctgacatgctctggggcggagaggaggaagccaggagctgagcgcgccgcgggggctgcttcgccctccggctccgagcgccgggctccgggcgccctgccctgcgcctgggcagcagccttgctggtcttgggggcgccccccgcttcccgccccgggggtccgcggccggcaggaccatgctgctgaaagagtaccggatctgcatgccgctcaccgtagacgagtacaaaattggacagctgtacatgatcagcaaacacagccatgaacagagtgaccggggagaaggggtggaggtcgtccagaatgagccctttgaggaccctcaccatggcaatgggcagttcaccgagaagcgggtgtatctcaacagcaaactgcctagttgggctagagctgttgtccccaaaatattttatgtgacagagaaggcttggaactattatccctacacaattacagaatacacatgttcctttctgccgaaattctccattcatatagaaaccaagtatgaggacaacaaaggaagcaatgacaccattttcgacaatgaagccaaagacgtggagagagaagtttgctttattgatattgcctgcgatgaaattccagagcgctactacaaagaatctgaggatcctgagctcttcaagtcagcctacacaggacaaagggggat

SEQ ID NO: 374657 - DNA, 5705 bp, Homo sapiens
tcaactttggtactattgacattttggaccagataattttttgttgggggctgggggtcctgtgcattgtaggatgctccatagtgtccctggaatctgcacactagatgccagtagcaccccttccctagttctaacaaccaaaaatgtcacaaaattgtcccccgttgagaaccactagattaagagatcattatcctgaaatactgaaaaactgcagacttgggccaaaaatcatgtcatgtgccattttatttttagatcagtgtgggtggaagtagtgccagccatcttcaagctgttagccaagacttgaggttcagtatagacctgcactctctgacgccatgcattctgtgcaaatttacatctgtgtgcaagttgcaccaaatctcaattgtaccagtgaatatcattgctctgccttctacatcctgcctcctataacagcaatgaaagtgtcctttctgttgttgaatgcattgatttaaacaacctctaaatctattttgaaagctatgtggaaggtaagtattaaaccaagcaaaactgaccctctgtccccaatgggatcttctaatgatgctttaggagatctcaggctatggtactgcccacatgctaatactttctacccaaacctagctcactttacaagaatcacccctaaataatttccactcttctctgttctaagactattttgacttaacttccttgccctcactccccctttggttggtttagctaactttatgacttactcatcataaagttagacaagtctctgcttttttaaacctccttggctactgctcagctaccatctttccctaaagtgtccccattgaaagtttgcatctaataacggaagttgccaacatcttgacctctttcagatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374658 - DNA, 5651 bp, Homo sapiens
tcaactttggtactattgacattttggaccagataattttttgttgggggctgggggtcctgtgcattgtaggatgctccatagtgtccctggaatctgcacactagatgccagtagcaccccttccctagttctaacaaccaaaaatgtcacaaaattgtcccccgttgagaaccactagattaagagatcattatcctgaaatactgaaaaactgcagacttgggccaaaaatcatgtcatgtgccattttatttttagatcagtgtgggtggaagtagtgccagccatcttcaagctgttagccaagacttgaggttcagtatagacctgcactctctgacgccatgcattctgtgcaaatttacatctgtgtgcaagttgcaccaaatctcaattgtaccagtgaatatcattgctctgccttctacatcctgcctcctataacagcaatgaaagtgtcctttctgttgttgaatgcattgatttaaacaacctctaaatctattttgaaagctatgtggaaggtaagtattaaaccaagcaggctatggtactgcccacatgctaatactttctacccaaacctagctcactttacaagaatcacccctaaataatttccactcttctctgttctaagactattttgacttaacttccttgccctcactccccctttggttggtttagctaactttatgacttactcatcataaagttagacaagtctctgcttttttaaacctccttggctactgctcagctaccatctttccctaaagtgtccccattgaaagtttgcatctaataacggaagttgccaacatcttgacctctttcagatatgacaatggatgatgttcgggaatacgagaaaaacatgcatgaacaaaccaacataaaagtttgcaatcagcattcctcccctgtggatgacatagagagtcatgcccaaacaagtacatgacaatggatgaagtccgagaatttgaacgagccactcaggaagccaccaacaagaaaatcggcattttcccacctgcaatttctatctccagcatccccctgctgccttcttccgtccgcagtgcgccttctagtgctccatccacccctctctccacagacgcacccgaatttctgtccgttcccaaagatcggccccggaaaaagtctgccccagaaactctcacacttccagaccctgagaaaaaagccaccctgaatttacccggcatgcactcttcagataagccatgtcggcccaaatctgagtaactttatataaatatctcatggggttttatattttcatttgttgttgttgtttttttttaagaatcttctgatagagaaaaagactgctttgtcactcaaacatgttccttcgacctttcagtgtgcatgtgactcagtaacttcacatagaatatgattccctaagtatgctacacagcatcatattagatgtaagatgtaagacttgcaaaggacagaaggaatcttctgtaaccacatagctgtatgccagagaggaagccttgttattgggcatttgatgaggtttggcatggacttcaaggataaatgaatgaaaactttgcaccacttttgttacaaggtacggtagaaaatagtgaagtcagtttcctctcatcaaatctaaaattctccaaaatactctcaggcataacatacttagctgttaaattttgaactgctaattactaatacttgaataccaatagttactgagattcctattttgtggttagtctgactcaggatttggagcctaattaactctaaacttttgaaaattttaatcatcaagctatagaggctccaagtgcaattaataataactcatttataccttccacagaatttaataaagattctacttgtttctgtcttttaataactttccccttttgtgcccttgtggcctcagaaatccttaagaattgcatggatgaatgtgaccataactgattttggaatggttcagtttaggaaccaagaggcccaggtgaggcaacatcttttttctctacaggtaccaacaaaccttgacttgtcagcttccatcatcaattaagattctcagaatttgcaattaattgaatagaattcatttactatctgcccactcaaagaagtacaagggtagagtaagctaactgggctttaacatggtcagaatgtctggtgcatgaactataaaaaagagaactgtctcccatccccttccttgttttactcttagtaacatccagaattccctggaacagattgcctaccaccagaccttagaaaagactgtcattctcttgctccttacttgaaatacaaatattgggaatgtcacagacatcaagcaactactgtcaagtgggaggagagaatgagcagaattgctgactcctatttgtagagtgaaaaggaggagtgataatagatgcccttctgtctagctttcctttcttcaactagtggtaatgcaagattagaatcaaggttgacaggaggcaaggtcactcactgaagtgacagaaagacaattctcctttgctccaaagagagaaatctgtcacctttgcacctcactgcctttaaacacagacgggagggcaggcccaaatctcagcattgacttttgtcctccaagagaggaagagaagaagtaattgggcaacttggaggcccacgccccagctagccttcctgatcgtaacctccaacctcaggaaagggaccttcccaaaacacagatcccaaaggaaacaaaatagaccaaggagcataatctgcttctctcacacagcctctctgccagtggaccctgcctgcttccctctcagtgctcagcactctgtgtagtgtctttcaggttgatacactctcccaaggtgcaggcgctggccccatgagcccagcaccaaagttttctaagtcataggtcagactgtcaagatcatttctttatctataggttgatatttagcttaaaaaaaaagaataaacctagaactcaaaggaaacctgttgcaaatagcttagatcaacagtgtatctcttccctaagaatgatagtatcttagtaagacaccttctatgcatggtatggaagcatgatttttgcttgtgggaaaacctaatattttatcagacccctcggacttctcaatccctccctctccacacagtagtacttaatgaaaatgttttgctttagagagcaaaatgctactttcagaagacactgaaatagtatatgtatttgcttaccatttgcaagctaaaatcaaggtgggatggggtcattattttcacatagaatgtatttattttgtgcaggctgttaaacacatctggcacctagtttttccattaagagcattgctattttccctttttataaagtagcttctgctgtcaaggttaacaattctatatgctttaggaagctaagttctaatttccttttgtgagtttcatttcttttataaccagtatgttaccacagacatcagttgcaaagctacgatgatagtgtgattcttagccgaaaaaaaagcgtgtgctcttaaagtatgttcagtttttctgtctacatatgctttgtgtgagttaaaaagggggtgggtggtgtaaatattcctttagctgctttgcatatttaacccagtcatcaaaaggcataaatgacttcaatattttatatatcttggttttcaagtatcatttcacattctctatacatgactttgttattgtggaatacaagcctgcaatgggtgtatatatacagaacattaataattcttagaaggatggaagccaaatggctgcatgatggaaattagaagaaaaaaaaagcagaaacttgaatttgctaagcatgtttggggggaaatagaatccttaactcagtgcctctgtctgcgatatggaaaccttcaactttgttcaccaaaattgtattatacctgtgtatatatatatatatatataaatataaatatagtatagtgaatcagacaccatcagttttaagtctctggtagccaaacttaaataaataatccatagaatatcacatacgttcactccatcttcatctctgaagttagtggagaccatcaaaatgactgtacatttcataactctgggaagatttcaaatgtgaagtgcccctgtgcattttcttggccatagcacggcattcttgctttagctgtgctttcctgggatgagaagatcttggtgtatttaacacataagctttgttagaaatcacctctgaagatcatttcattttctcactttgggttgttgcaagacaaagcaaaggaaaaggaacacaatgaaggaggccgtgacatttttagttgccaccgttgtaactcaaacaatatgggtttgttggtgaactgatttatcaaggcttctgttacggttttgcatctgtgtgtgaggaaaattttaatttatttggaagtatttattagccatgttgttggtcctgaaaataaatctctaagtagcacagttgtgggtatattatgcagacacttaccacaatacctgcaaaagtaactgtggttttctttcaagacactgtaataaacagtgaactaagagaatagattctgatacatctcgataaatcattctctgcaaaagtttcagggctaatgtatttatgtgtatttttaaattctactttctttggcatctcttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgtttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaag

SEQ ID NO: 374659 - DNA, 2042 bp, Homo sapiens
acaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaa

SEQ ID NO: 374660 - DNA, 3182 bp, Homo sapiens
acaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaagctgtggcctctgtcttttgagcgcttatgaccacagcacgggctcagtccctcccagacccactcgctgtctggggataatgggcagcccctccttgcccactgtgccaacatgcaggtggcccctgagcagcttccatgggtggagacgctgctctgtcagtcacaggcttggaaaaagcgagtccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggatcccttgagcctgggagttggaggttgcagtgagctatgatcacaccagctttctagcctgggtgacagagcaagacccaactcttaaaaaaaaaacattgcaacacaaatgagagacaaagacctcacttatcttcattacagagagttcgtaatgtcaataagaaacagaaaaccggaaaggcaaacaggttaagggcatgggcagcaattgaattacaaagaaacagacagacccttaaacatcaatgcttgacctcacccaacagcagggaaacagtctccacaacagtaaaatgttgctgggatgggcccagcattcagcatggtccctgcaactttggcctctgcccagtgacctctggcgggtgtagaagagctcatgcttcagtgagggggtggggggcaccctgaggaccctgtcaacatcagctggaccacaggcatctcagatagatgtcacttaccaccctcatgttggcagagggtggtaaccagccagcatctccttcttaaacacctactaagtgtcaggcactgtga

SEQ ID NO: 374661 - DNA, 2707 bp, Homo sapiens
acaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaagctgtggcctctgtcttttgagcgcttatgaccacagcacgggctcagtccctcccagacccactcgctgtctggggataatgggcagcccctccttgcccactgtgccaacatgcaggtggcccctgagcagcttccatgggtggagacgctgctctgtcagtcacaggcttggaaaaagcgagtccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaagctggtgtgatcatagctcactgtaacctccaactcccaggctcaagggatcctcctgcctcggctcctgggtagcgtcgacgcggccgcgaatttagtagtagtaggcggccgc

SEQ ID NO: 374662 - DNA, 310 bp, Homo sapiens
cctattttttttcttaagtagctaatagattttttttttaaaaaagaacaaacatcataaagcaaacctggggagaaaaaaagcaacaaaaagttttgtgtgcaaattacaaaataatatgattgcaattggtttaagttgttaggcagctgttttgtcaaaaactaacaatagggctgaatttatttttgttaacaaattagagttttgctttgattgtgtttcttttaggcttttctgcttttttcttcctcgcataaatgaaccaaatattttctctctgatattccacaagagaaatctctcactt

SEQ ID NO: 374663 - DNA, 432 bp, Homo sapiens
aaaatttcccttctcttccaaaacctttcccctttttctcaattggagagagagagaaagagagagagagagtgagtgaatgtgtgtgtgtgtgtgtgtgtgtgtgtgtgtgtgtgtgggtgggtgtgggtgggtggtgtgtgtgtattcttgaggtttctgaagttacctatgtatactggagtaaggagaatttgagattagagagttaatattagaaatttatctatgtgtatgcttatgtctgatggcctatgagtttattgcaggcaaggtttggctctcttttaaaacggttttgagctaggcctccatgctttatgttaaaaagtaagttgttcaattaatgttgattgtccgtaactaaccattgtttaattagaaagcatcttttcagaatctctttatacaaatcctttgatatacttttgt

SEQ ID NO: 374664 - DNA, 477 bp, Homo sapiens
ctttagttctcacgaaattgtagaatttgctggactgcaaaatcctgagatggggctgtactggtgagaacgatctgggatctattcttctctcccttagaagcagaatgttcctccaggttttagcagcatgtcatgtcgcccctgatgtatgtcacccttgggtttgcccttcatgatccctcagctgcagtgcaagtggggcactcacagtcaagactccaaccacactaagctgctttcctcagccttgggagaccagctcacaataaatcctaagcctccgttgtcccttgctatctacttataagtaatacatccactttgtgtaacttgtacgcactggtgttgtgtctcaccagattcacacgagtttgtaatcagtgcatcgtgaatcgacttcatatataaataagctatctaaaataaatttataataactcatgcataataaagtataatttactttttcatgta

SEQ ID NO: 374665 - DNA, 2373 bp, Homo sapiens
agtaaaaggcggaaaccgcggaggcgtcttgattttccggtcggagagatagcttgcttcctttaagcctcggggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaa

SEQ ID NO: 374666 - DNA, 2724 bp, Homo sapiens
agtaaaaggcggaaaccgcggaggcgtcttgattttccggtcggagagatagcttgcttcctttaagcctcggggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgagggcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaa

SEQ ID NO: 374667 - DNA, 1388 bp, Homo sapiens
agtaaaaggcggaaaccgcggaggcgtcttgattttccggtcggagagatagcttgcttcctttaagcctcggggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgaggggtacagtatggccagattcagtgaccaacctgcttttaggcagatgtcctcggtattgaccccagatttcctgtcttctagcccattgctctttctccaagcctgatttaacctattcctggtgggttttacacaccgtctttctttctgtcttttctttctttttccttttattttctttctcttccctgattcccttcctccttctttcctttctcttttcctttctttttttagagtcagggtcttgctttgtcgctcagactgcagtgcagtggcgcgatcacagttcactgcagcctcgacctcctgggcacaagcaatcctcccagctccccagtagctgggaccacaggcttgtgtcgccacgcccagctaattttttttttttttatggagtcggtgtcttgctgtgttgcccaggctggtcttgaactcctggactcaagcgatccacccgccagggccttccaaagtgctgggattacaggtgtgagccaccggtacctggccacactttgtatttctcaggaggctggaccttggccttctccgctccacccttactcccttccctttggacttgagg

SEQ ID NO: 374668 - DNA, 564 bp, Homo sapiens
gcatatcttgttcaaatactgcgtttcagttatgatttccctatcccagctgtcgttttctttagatctcatgtagcctcaccagccatgccacatattggagtgcagtaatgccgtgcctggtcttttgggtaatccctggtttctctgtctacagcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagaggtgagaagcacatgcttgtttcactagaagaggaggaggaggtactggagtctaagataggtttctgtgttagtta

SEQ ID NO: 374669 - DNA, 3160 bp, Homo sapiens
agtaaaaggcggaaaccgcggaggcgtcttgattttccggtcggagagatagcttgcttcctttaagcctcggggcagaaccacagagaggctacagccgtcctggcctccctccggccctgagagctcctctggcctgtctcaagtcttaacgtctcaagcgcagactgccggctccgaacggggagaccaggcttctgcaccggaaacaaggcaccggttgtgacgtcacagccgcagagcgcccgacttcccagaaggcaccgagtccctgccgttctcctcaactggcggcggcgcgaacgaatagtcgccggcgacctcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgcc

SEQ ID NO: 374670 - DNA, 536 bp, Homo sapiens
aggttccctgctcagatggagagttaaacgtaatagtaaggccaggtacagtggcataaacctgtagtctcagctacttgggaggatcccttgagcccaggagttcaagaccagcctggcaagacatagcaagatcctagctctttaaaaaaaaatagtaattccccttcctcaaaattatattaataaggctacttcatctggacattcatcagtctcaaggtatggttcatctggagacagaatcattcctgcacttggtacttttggagtctgtttattcacctcacaattttaagtactttatatttaacaaaatacaaaaactgggtgctttcataaatgttttctcatctaattcttggaacagcttagtggagtatttaatattatcccccattttacagatgcagacctctgttgaatgactgccagacgtaagggttctgctttgagaaactgatagaatccaatttatgttctgtagattatgctgtttccatctcacttcaataaatacttatcaagcaaatact

SEQ ID NO: 374671 - DNA, 352 bp, Homo sapiens
ggtaagagtagccctgactacggaagtgggctgaagggtgctgtcccaagaaaagcggaagtatctgttgagtcttgtttcctgtcacatcctggagctgaaggtagtcacatttcaaatttaaaaaaaagaaagtcatgtgaagttaaccagtgagattatcttttacaggcaggataattagaatcctcagtggtgtagaatcttccacctacaggcgggttgagttttatcacagacgagaggggccatggaccctcagaaggccttagctcctggatttatttagtctgacctttggagagtcaaattaccaagaggtgatcgcacttccaactaaaattgagaatgt

SEQ ID NO: 374672 - DNA, 1227 bp, Homo sapiens
ttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaaaa

SEQ ID NO: 374673 - DNA, 724 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374674 - DNA, 729 bp, Homo sapiens
ctgagccaccagttatttttgcacattaacaagtggagccctagtttaactctaaaaatcgccatgtagagcttacttatactttcaaataaatttacatgaatttacttaatatattaaaatgccacttaagtaattccataaactatggctcagcagtccatctttccttgagagtggccctggttaatctttatgttaatttttttccaagactcctgggttttacagttaagaggttcagttaatcattaaactgtatcgttgttagcacgtaggtagctttatattacttgtaccaacaaaacttaatttttgacacacctctaataacatcacttttctgttttggaagatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaaaa

SEQ ID NO: 374675 - DNA, 556 bp, Homo sapiens
ctgagccaccagttatttttgcacattaacaagtggagccctagtttaactctaaaaatcgccatgtagagcttacttatactttcaaataaatttacatgaatttacttaatatattaaaatgccacttaagtaattccataaactatggctcagcagtccatctttccttgagagtggccctggttaatctttatgttaatttttttccaagactcctgggttttacagttaagaggttcagttaatcattaaactgtatcgttgttagcacgtaggtagctttatattacttgtaccaacaaaacttaatttttgacacacctctaataacatcacttttctgttttggaagatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374676 - DNA, 3210 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374677 - DNA, 3250 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgaggacagggtcttgatctgtcacccaagctggagtgctgaggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374678 - DNA, 2991 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaaggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374679 - DNA, 3049 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcagtgtataaaacctctgaaggggggagaggaaaagccgcag

SEQ ID NO: 374680 - DNA, 1054 bp, Homo sapiens
ttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374681 - DNA, 2872 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaaggtagttaatgtttaaataaaaggattgttaggatggtattattatacttgtttctttaactttatactactttgggaacttgtctaatttctgtgatacaaatgattggacaaatgcttgttgatttgtagttaaaggatagtttttgataattcatgcacttgaccttgttctaatatttctttctaatgccctgtaattcatgagcatgtagtcacagattatttagttaacagataacacattggtgtaatcctaagtaatgagagattcgctttctttgctttggttgctctaatcacactctagaactgatggagtccgtcagggatgcacttctccttgtttccatttgaacactttattcttctttagaattttatccttctaagtttgctatgtctgaatctccaataggtttgctattagtaattattcccctagtgaaagaatttattcagtaaattggcactaagttattttgttgtcttaattatatcctttgcaacctaaaatgcttctgagtacagaaaatatcaaaactaataagaaactggaggttttttctaagattatatctttcatgtgttaatattatacacactctgagtaagtagtgggtttttctcactttctggttttacagttaaaaaaaaaa

SEQ ID NO: 374682 - DNA, 2994 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaatctgtgccccctgatgtttatacagaccaggtaataaaacgaatgataaatgttgttctttgttgaattggcacacacaggtggccatttatgtcagttctcagagaaatgactacaaaacaggttaatctctgcagaacaaccagcctgaagctaggatctaactacgatactatggggttgtccttggacaactggcttctccctaaagggaaacgttcaacccactgggtcagcccggccaaattggggggcaccaaagttctggggcgaggaaaaatttccagggaacttcgacatcttaagggcacagggtttttcagagccttcaaacactccctcttctgtgtttgttgctcctcgc

SEQ ID NO: 374683 - DNA, 2144 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcataaaaaaaaaaaaaataccttgagggggggcccgggtccccattttgccctattgtgagtcgattttacattcattggcccgtgttttttacaacgtacggtactgggtaaaacccttgctttacccaaatttaattgcccttg

SEQ ID NO: 374684 - DNA, 551 bp, Homo sapiens
atgagcgtctatacttgccagctatgaaaggtttaattgcacactctgtatgtccttgaatgtcatgacacttttgcttggcagttttccatccccttcagttttctgaactggctttttgccagcttctcattcaaacaaacctctaaaatttgtggttgaggtcactgatgaagagaatattggtcagacagacacgtgtataaaggtttttgaaattaaaattggatggaatccataactatgagcggattcaatgtgatctataaggcttaatataagagtaattcaagattaccttgtaaaaccaagctttcattacatgaaaccattttcaaatctttgttaatgtaggtggccattttatgtcagttcctcagagaaattgactacaaaacagcgtttaaatctctgcaagaacaaaacaggtatgaataatattttaaaaataatgaggtcaacatttttctgcttaagaagtaactgaattctgtctttcagtcatgatgctatggactcctactacgactacatatgggatgttaccattt

SEQ ID NO: 374685 - DNA, 3383 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaaaa

SEQ ID NO: 374686 - DNA, 3370 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374687 - DNA, 1049 bp, Homo sapiens
gcaagaccctgcctccaaaaagaaaagaaaataaaagaaattctgaatttattcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacata

SEQ ID NO: 374688 - DNA, 3045 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtgaattgttttcgtgggctggctggtttcttgcctacctgtatatgttcttcctgggtccccttttggctgaacttacccatttccttgtaatgtgatcgtaagtcccaggttcatggctctagaacacattgctctgtgtattttcattgtccttatttctagcacctattgctgtcttgattcccccaaaacacctcaaattcaacttgtccaaactgatttgtgtctgtctttaccataaagtaataaactcctaatacactccta

SEQ ID NO: 374689 - DNA, 3065 bp, Homo sapiens
tggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctatttgggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacct

SEQ ID NO: 374690 - DNA, 1742 bp, Homo sapiens
aagtaggtgaagattttagggcagaaattttcagataaagaactgcaactgcaaaggtattaactgaggattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcacggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggc

SEQ ID NO: 374691 - DNA, 5466 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaatttttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggcatgtttgactctaagatcttgtaactttaacagctatgctcagtataaagtgccgggcagaacgcgtttggccccaaccagcacccccgccccagcctaccttccaccagggctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgccccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcgtagtcagatcgagccgcgtagtcagatcgagccgcgtagtcagatcgagccgcgtagtcagatcgagccgcgtagtcagatcgagccgcgtagtcagatcgagccgcgtagtcatatcg

SEQ ID NO: 374692 - DNA, 4643 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccagctactctggaggctgaggtgggaggatcacttgagcccagttcaagaccagcctaggcaacatagtgagaccctgtctctaaaaataaaattaaaaaggctgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggcatgtttgactctaagatcttgtaactttaacagctatgctcagtataaagtgccgggcagaacgcgtttggccccaaccagcacccccgccccagcctaccttccaccagggctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgccccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcgtagtcagatcgagccgcgtagtcagatcgagccgcgtagtcagatcgagccgcgtagtcagatcgagccgcgtagtcagatcgagccgcgtagtcagatcgagccgcgtagtcatatcg

SEQ ID NO: 374693 - DNA, 3904 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaatttttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggc

SEQ ID NO: 374694 - DNA, 2492 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaatttttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtccccgtacatcgttagaagcttgaattcgagcagtagtagtagtaggcggccgc

SEQ ID NO: 374695 - DNA, 484 bp, Homo sapiens
ggccccttaatggatatgaggcaacatgaagagtacatcgcagacatggctctggatccagccaaaaagctgctgctgacagccaggtacaacttcaaagctgccttgcctcccctcccctccctgtgtgaaatgtcttcctcaaatagaccttgcgtctaagcctactgctctactctctacagcggggatggctgccttggcatcttcaacattaagaggcgtcggtttgagctgctctcagaacctcagtctggggacctgacctctgtcactctcatgaaagtacagctggttatggtgggatggaggggtgtgtgctgggggcttagtctgaggcagcttccacattgttttctctatttccctgcagtgggggaagaaggtagcctgtggctccagtgaaggtaccatctacctcttcaattggaatggctttggggccacaagtgaccgctttgccctgagagctgaatctatcgac

SEQ ID NO: 374696 - DNA, 3192 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcacccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttgctatgctcagtataaagtgccgggcagaacgcgtttggccccaaccagcacccccgccccagcctaccttccaccagggctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgccccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcagggtggacgctggagacaagaacctcagggtcacaagtttactgtttttctcccttttccatccctacattggtctgctggggaaggcggggctaggcatcactgacacacgcagactccgtggttgaggcattttattggacctttggcaattggtggtggggaggcatctgctccaactggtgcggggccctgcagatgggaccatctcaggctgggtccttgtagcccaggagcacagactggactaagcctcctgggccttgtatgaaaaaggtgttgtacctggccgtttttgccagtaataatcaataaaataaccataat

SEQ ID NO: 374697 - DNA, 2514 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaatttttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagagg

SEQ ID NO: 374698 - DNA, 4971 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccaggcaagagtcttgcttattgggctgcatccccagagaggatatgaattattttttgaaaagacagggttttgccatcgtccaggctggagtgcgctggcttgatcttggctcactgcagcctcaatgtccccaggctcagattgtccttccaccttagcctctggagcagctgggactacaggtgtgcactaccacaccaggccaatttttgttttttttttttggtagaaacgggtctgttttgcccaggctggtcttcaactcctggactcaaatgatccacctgcctctgcttcccaaagtgctgggattacaggcacgagccaccacacctggccaaaaaaatttatattttttgagacaaggtctcactctgtcacccaggctggagtacagtgggttgatcatggctcactgcatccttgacttcctgggctcaagtgatccacctcagcctgcctggtagctgagacttaacaggcatctgccaccatgcttgactaatttttgtgatttttttttggtagagaccaggggtttcactatgttgaccaagctggtcttggaactcctgggctcaagtgatcctcctgccttggcctcccaaaatgctgggattacaggcatgagccactgtgcctggctggatatgaaatttttttttttttttttttttgagacagggtttcgctcttgttgccagggctggagtgcaatggcgtgatcttggctcactgcaacctccgcctcccgggttcaagcaattctcctgcctcagcctcccaagtagctgggattacaggtgtctgccaccatgccaggctaatttttgtattttcagtagagacggggtttctccatgctggccaggctggtctcgaactcctgacctcaggtgatccacccgcctcagcctcccaaagtgctgggattacaggcaaaagccaacacacccggcctggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggcatgtttgactctaagatcttgtaactttaacagctatgctcagtataaagtgccgggcagaacgcgtttggccccaaccagcacccccgccccagcctaccttccaccagggctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgggggtggcccgccatacttcctctgcccgttcacctgcaccaggcggatgcctgtctccctgacccacgcctccagcgccgccttgttctctggattcaccctctcacaccacagctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcgtagtcagatcgagccgcgtagtcagatcgagccgcgtagtcagatcgagccgcgtagtcagatcgagccgcgtagtcagatcgagccgcgtagtcagatcgagccgcgtagtcatatcg

SEQ ID NO: 374699 - DNA, 4455 bp, Homo sapiens
  misc_feature (1)..(1): n is a, c, g, or t
nagtgtgggtggttccgaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagaagctcattactgtctccaaggacaaagccatccatgttctagatgtggagcagggccaactggaaagacgtgtttccaaggctcatggtgcccccatcaacagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaatgggggaagaaggtagcctgtggctccagtgaaggtaccatctacctcttcaattggaatggctttggggccacaagtgaccgctttgccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggggaagaaaaggaggagactggggatgacagtgactgaaggaatgaattgaatcttgagacgggtcctcaccaggcaagagtcttgcttattgggctgcatccccagagaggatatgaatttataataccctacagtgcaacacaagaagatgcactcaaagcactgatgtgaggaagtacttgccccgtagcagctattcactctaccagtgtaaacaaactctaagctagggcaagacagcacagacacaagtatatactaaccaggggtttaatataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggacaaggaacggccatggaagatcactgggtcaggttggaccctgggctgggagcgggagggcaaggcccctcaccacaacttaacccaaacctaagctgcccccaggtgccataggtccctgtcccagcagggaggctgatgggcctgggcccatgcccctccccacctttgggggtcagaaagtggccacccaggcctgctgggatggggcctgacacaggctctgcatgcccattcagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggcatgtttgactctaagatcttgtaactttaacagctatgctcagtataaagtgccgggcagaacgcgtttggccccaaccagcacccccgccccagcctaccttccaccagggctttttggccatggcagcggcccggtgcgagctgaatttgagcagagcgatctgcccgggcgccggtccggggctgggcagcagccgcgcctcctgcaagccgggacccagcggctgcagcgcgagcagcagcgcgctgcgggtcagattcggcggcaggccgtcaacgctcagctcacacttctcggtgctgcggcacacgagcagcgggcaggacggccgcagcggatggttgtgcagcgtggcgatggcggcctgcgcgccgcgcctcgagctgtagcgggcataggcgaagccgcggttcaggccgctgaaggtcatcatcaggcggaactcgtagaggcggcccacgcgctggaacagcgggataagctggtgctcgtacacgtcctgaggcagccgcccgatgaacacctctgacccagctggcggcgggctgcccacccagcctgtgggaagagggtatgcaaggccaccgtcaggcgacgctttcgaattctgagcccacggacccagcgcgcgggggtgggaggcgatgtgaacaaaggtctgtgaaatgggtttacacccgtaccctgggtggttggcataattaggtgactgcgctaacaagggggctggcacagagtaggtacaccttgagattggccccctccctcgacggggcgggtggacgtggagccacagttcctcctttgctggggggtataaatccgggtagttcgcagtttctgacagtgaaggctcggagcagcccctcccccaaagggggctggtgtagccggacaggcggaggggctgggactaccgtacctgggggtggcccgccatacttcctctgcccgttcacctgcaccaggcggatgcctgtctccctgacccacgcctccagcgccgccttgttctctggattcaccctctcacaccacagctgagagggaaaggaaggttggaatggcggatcgccaagcgcgccccccacctctcctgtggtactggggtccctaaagccgacccccgctccggcggggctcgccggcccccaagtcgccagccgcttacctcacaatcccgcttggactgcatggctctccagctggccccctcgtaccctctttataacttcctccccaccggcctctggaagcttccctacccctccaccccgcaagctctcattggctctgagcgcgaccccgcctcccaggggggtggaggtatccactgcacgtgcgccgcccgggcttcgctcagaccttcaggtgaaagctgcaaagtcgcgggtgcgtatgtacgggggctgcctcccgaggaggagctcccaagccgcgtagtcagatcgagccgcgtagtcagatcgagccgcgtagtcagatcgagccgcgtagtcagatcgagccgcgtagtcagatcgagccgcgtagtcagatcgagccgcgtagtcatatcg

SEQ ID NO: 374700 - DNA, 522 bp, Homo sapiens
aacacaccctacatatttaaaaatcttcatatttacaaattaaactgagaggagaatgaaaaagccatgtgaaagactgctgaagttgataaaatgttcaaatgtttttcaactagagataggaaaatagcttacagtacaaaaccttcactttgttctaaggcccttttgttcattgttacaaactggtgtagttcacaggaagccaaagcttgatttccagtaagttcccaaacttctgttctcaacatttaacttagattttagatgatcatattccaaaattggaaagactgttgaagaggaaaacaaggaccattgattcacaatggcagcccagcatttatttattcattcaatcatccgtcaatcccaaacatctatagatgcctccgtgttccagacaccatgccagagctgagagtacaaagaatcacagaatattgtttaaagatgtttactgcagcataatttatgaaagtaaaaagttaatggaaaataaaaaaattgatgcaaccatca

SEQ ID NO: 374701 - DNA, 2199 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374702 - DNA, 2445 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgtttaacaacaccaaccaaacaacaaaaaaactccagaggccacaaaagccgaggagccgcgaacaacagggaccaggaaccaggggcccacgttgtcccagaccacgcgttccccggagaaccccaaggtttatctcgtgttccacaacggtggggaaaactatgccccagatctctcgcctaatatacagaagctccaacataagagtcccgtataagcgcccagcgttctacacccggcatattatga

SEQ ID NO: 374703 - DNA, 1979 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374704 - DNA, 1725 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374705 - DNA, 1259 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgataggttatcggtggagagtagggagcacaaacctggggtcccattctagcttgaccacttctcggctgtgcacaaactagtctagctctcctgagcctcagttacctattttgcaaattagggatgggaacat

SEQ ID NO: 374706 - DNA, 956 bp, Homo sapiens
  misc_feature (209)..(209): n is a, c, g, or t
  misc_feature (396)..(396): n is a, c, g, or t
tgcgacgcggtgggctgaagctgtggcgtcgcgcctggcccaaggctcttctgagcaccggatctgtgtgtgtcaagctgagtgcacaaatgaatgacgatcgacatgtaatacagcctgaaagacgaggtgccctggccggttaagaggcagcgatcggatgtgctatgtagaaatatatgtcattacctaggtagactcgtcttcgntggatagagcagagccgtctacttatcctcgtgtactggtgggaacgtaatttgcgcatgacaatctacccttcacctgtacgattctttatacgacagcgttagcgcgaatatggtcgatcgttgtagagatatggtatgattgctccattcccctaagtcttgcaatatgtcgtggtctgtgagnagcacattgagagcttctgctatattgagtgctcagccgataatgtggctcggacttaacttgtgtaaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374707 - DNA, 1870 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagagattgggtctctccacattgccccggctgctctccaacccctgagttcaagtgattcacctcccttggcctcccaaagtactgggattacaggcgtgagccaccgtgcctggctgagaagatggatttaagacatattttggagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374708 - DNA, 1824 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgaggtatggatgttcccatccctaatttgcaaaataggtaactgaggctcaggagagctagactagtttgtgcacagccgagaagtggtcaagctagaatgggaccccaggtttgtgctccctactctccaccgataacctatcaaagggctttgcaagagcttttgactaatcgtctgtcaatggttcttcattcacgtattaattgcacatcagtatgtgccaaatctactagacattggagaaacagtaggaacaacacatggtaccggcacatggatctttcaggaaaacgaagtaggtaataaacaggaaaaagcccgagtctgatgctaagaagaacataaacaggatgctgagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgtttaaaaaaaaaaagaacaccacaacaaacaagggcggggccaaaaagttccccagaagagccccagtttagggtatacccgctttttgtggtacaggggccc

SEQ ID NO: 374709 - DNA, 2081 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgagattgggtctctccacattgccccggctgctctccaacccctgagttcaagtgattcacctcccttggcctcccaaagtactgggattacaggcgtgagccaccgtgcctggctgagaagatggatttaagacatattttggaggtaacattgtcaggacttcctgaaggattagatgtggaagggaaggataagaaacagaccaaggataactttcaaatgtatgcttaagcaactggatggataatgatgccattgagtgagtgaaaaacttgatggaagtggaagattcagagttcatttctatctaggttaatttgagacataccagagcataagttaagtaagtaattgaatattggagtggagacttatttgtctaccgaattattgttttctttgtcggacatacacctacactgcattcctcaaagtaaaatttaagtgtggctctgtgcctatgctctccccagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgtttaacaacaccaaccaaacaacaaaaaaactccagaggccacaaaagccgaggagccgcgaacaacagggaccaggaaccaggggcccacgttgtcccagaccacgcgttccccggagaaccccaaggtttatctcgtgttccacaacggtggggaaaactatgccccagatctctcgcctaatatacagaagctccaacataagagtcccgtataagcgcccagcgttctacacccggcatattatga

SEQ ID NO: 374710 - DNA, 1506 bp, Homo sapiens
gcttctgagtccaattgatactgtattcttctaaaatggaagtttccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtctttgtgctgggccccacgcggccgcctcctagcctcatccccagctggggaggcaggctcctggggtagggcgaggcggggagggcctcgacccggggcgccgtgcaagggcctcgcggggccgccgcttagacctgggctcgccaggtcctaaagaagagcctgcgcctccgcctccgccgcctgcaccgccgcgaagccgaagccgaagccgaagcagagctcggcgccgctgctcccgccgccgcctcagcgccacacatcgccgggacacccgcgccgggcagccccgccggccgccctcacgcacgcgctgtgccccgcgggagctccaggccgcccctcctgccgcccagcttcgtgactccacggccccacgcgccccttgctgccttccgctggggtttccgagccgcccccgaaccgcgcacccgacttgcaggcgtccgcctgggcctccctaagacacgccgcatacaggacaggcccctgggccttccgcggcgatggcgctgcgctaatgacgtcataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgagattgggtctctccacattgccccggctgctctccaacccctgagttcaagtgattcacctcccttggcctcccaaagtactgggattacaggcgtgagccaccgtgcctggctgagaagatggatttaagacatattttggagcggaaagtgaccagaagaggtgtgcagtttccaggcctggcccatacagacctccaacaggtgctcccctgtgctgttactccttctgccaactggaagcagatggtgaccaggctctggagaaggcaaggcctgaagatgggagattcctaagtggaggagaactgtgccttactgacctaaatatccactcagtattgttatgtgagaataaataaacttgtgttgaccgttta

SEQ ID NO: 374711 - DNA, 507 bp, Homo sapiens
cagctgagcacaaatcacactcaccagggaagctggcgggagtcggacacacacctacacccacacccataacccttggccccagggctgtaaagcgcgatccacggaatccgggggaggccgaaacccggtagtcgatggaacctctcactgcaaaatctccctgctttttgaggctagagccgagaagaacgccacaggacaacgcgggggaagagggggcacctcccccttaccttgatggctttgtccatgtcgctctcctccgacatactcagtggggcccccacagccgggagaggcggaggctgctcagcagccctgtccccgcgcggccgagggagcaaagggctcggcactcgggcccctgggcctcgtggcgacgggcagcagccgcccctcgggaccggtggggatgaggaccccggcgccggctctgcttcggcgggcggctctaggctggcggcagcagcagcggcggaggcggcggcccctggggacaggtct

SEQ ID NO: 374712 - DNA, 496 bp, Homo sapiens
tgtataataggagttgaacatatggatcaggaactctagagagaaatccgagtttgagattggtatatgtgcatgtatctacatacatattacttttgggggagtggaagagtggagcagtaggcatgctccatatcagataagctcatccgaagaagtgtgttgagattaggaagagtaaaggaacagaaatggaaccctaaagaacaccatcacttgagaaatagacaaaaagaataagcagctagacatgtagaaaacaaaactaacaagtgtaccgaagccaagaactaaaaattcagagtcagtagcagtaagtgctacaaagtggtcatttcagattagcacttccaaacattttctgaatttagcaagagagtgattattagtaacctttgtgaaagcagactcagtagaggggtgcaggcaggaggcaggttgcagtgggtgagggaggcatggcagacagtgtgtgccaacaatggtctcagcctcg

SEQ ID NO: 374713 - DNA, 407 bp, Homo sapiens
taaattatattttatatttattagcacagaagaataatgagagccacattttagttcaacttcttgtgttagctttgatcaaagtcaggacaataatcattgagaaggtgcatgtctaataaaataggtaaatttaataattgtgagacttccagtttttatctccaaggttgtatttagagtggagaaacccaacaactcattacagtttcgctaagatttgaaaggttaaaaaaatttatttccttatgatagatgccatacttttccatatggagtagtcaggaaccatgaaattttttgcattcagtttttttaataacatttgttttctcacagtatggatctagttcataatgattcagattcttttgctgaaacacaattagcattgcagggagccttct

SEQ ID NO: 374714 - DNA, 965 bp, Homo sapiens
agcgggcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagttggagagaattccctgttaaatccctcaagtgaaccccagtccctttgggaactggcaaagcgtgtgaagaatctcaccactcagaaattttccgaggttcgaaatggttaacgaatccatgttagaacatcc

SEQ ID NO: 374715 - DNA, 1138 bp, Homo sapiens
agcgggcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatcacaggagttcttatttat

SEQ ID NO: 374716 - DNA, 842 bp, Homo sapiens
agcgggcgggctcctttctccgtcgccgctccaggacgcggcctcgggggagccctaccgggacggagccgcggggcctgcgacttcccccggagctggcctgaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatcacaggagttcttatttat

SEQ ID NO: 374717 - DNA, 819 bp, Homo sapiens
gtactcaaagagtctcatttctcttgtaggttacagtcccaccatttgttgatcctctgtttcaaagacagcaagaggtggatgaagagaggagaactggtcttcagtgtgagacaggtgctttgtgatcactgggcctcatttttttgagactgctaattgtccagtgatttctcactccttcaagagcaactggagttcttgaagagtgttgatttcgattttttatcttcctgtaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatcacaggagttcttatttat

SEQ ID NO: 374718 - DNA, 1153 bp, Homo sapiens
agcgggcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagtgggtgaaagaaagggtctggtgagcagaggcctggggcggggctggcatgcagggctttgcagcacccacgagcagcacatactggttccagaatgagccaccgccacagccctccctgtcagacaggcacccaagggcggaggaggcatggcccaagaagaagggtgtgaagaggaggagggagaaatggcggtggcctcaggctcagcactgcagctctgacagggcccctcgggcggggaagccttgcatgaagaaactcagacaagtggtaaatgtgggacctggaccccactttccggagacatcctgtccttccgaggtgagggccaacctggccacaggggcttttccccctgagatttcttcagcgccttcgcccgggcctttgcccttctgccactttcctaccattttccacttactccatccaaactgcaccaaagatggtgttctccttagtccacacacaactggtgggaagtttttgaaatgaaatttataccaaa

SEQ ID NO: 374719 - DNA, 949 bp, Homo sapiens
agcgggcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaaggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacagtcctgaaaagctcatctgtgcagacaagaaacagaaaagaaaagagaaaaagacggccgacctaagtcaggctgcgtttgaaaggcagttcctttcctcaaagctcagccagaagaacaaagtgggtgaaagaaagggtctggttttaggaaccagacagcagagaccccgttcctgggctgctggggacagccaacagcacaggggtccccagcctgtgggaaaaagagtgatgacagctgaggtgctggggcagcacctggcctccctgcagaaggtggccaggcagggccacccttggtactgaagcttcgtggacttgacttggcagtgtctgtacagcagttaaaatactctaaacatattttcttcctccagaagtggaaataaattgcaagaaatacccaaatcacaggagttcttatttat

SEQ ID NO: 374720 - DNA, 891 bp, Homo sapiens
agcgggcgggctcctttctccgtcgccgctccaggacgcggcctcgggggagccctaccgggacggagccgcggggcctgcgacttcccccggagctggcctgagggattctcctgtccatggctgccaccaaaactgcgagttatgatgaacatttcaggccagaaaagttaagagaatggccggagcccgagtccgtttctttaatggaggtattagctagagaagacattgatgaagcagtatgtgcaatattatttaaagaaaattccattgtgaagagattggatatgtattttcagcatgtggatacttttaaggaaagaagaaaagagatgttacataaaaaatgggttgaaaatgttgcagagcctcttcagcagagaattatggaaaaagtaatttcatataaagagcttaaaatgaaacaagagaatgttgaatattatttacagcacagacataaaatggttacagtcccaccatttgttgatcctctgtttcaaagacagcaagaggtggatgaagagaggagaactggtcttcagtgtgagacaggaaaacgacattccataaaagaacttgaagaaatagagaaggccaggctgcatgccagctcgccctacttcactttcacttcacactgtgtgattccaaaagagtggcataaagcctctgcaagagccaggagtaaaacttacaaatacaggtacagatgagcagaacaaacaaatatttgtttaacttgcaacttactttatttcctactgaagctcttgtaactagtcacacttttgtcttttagtagtttatagttttattattattatcatcacctttgtattatgaaatatatgtagaggacagaataaaacataaacagcttaccga

SEQ ID NO: 374721 - DNA, 260 bp, Homo sapiens
cagtttagtgtgcagcagtgggtgcaggcgggcgagtgggccccacaccttgtctcttaagtggcctgcacagtgcgaacagctggatctgacaacaagatgtcaccagggtgagagccagagtgagggacgtgctgtttccctctcccagcattgggagtatctgtgggttcagcactagcactcggggacagctcccagccgggttccttgcagctcctggacctgctatttcaaggtgagaatttcctcccccagag

SEQ ID NO: 374722 - DNA, 315 bp, Homo sapiens
gtgggtgagagttctgttgtcctgtggtctagccattgtctctgtatactcagtctctcaaaaacaattcaaaatttgatgtctgaaatactgaaaatgtttttagcatagtctgaaagcagaattcttccttcagcatgcagattgttaccttgaatcttgttattttctgtctatcctgtgatgtctatagcctgaaggaacacaatagagtaggtgggagcaattaattgtgtaacaagttaggaaacagctccacacaaaaaagataaatactttttaatagaaatgagatcaagttatgcaccctatagt

SEQ ID NO: 374723 - DNA, 890 bp, Homo sapiens
agcgggcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374724 - DNA, 904 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374725 - DNA, 1241 bp, Homo sapiens
agcgggcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagttaaaaaaaaaaaaaaagaggggcggggcggccctttttttttttttttttttttttttttttttgggggggcgaaaaccccctggttttttttgggaaaatttgtgggccaattccctttgtggggggcccccaagggggtgtgggcggtaaaaaagcgggggggggggagaaaatattgcgcgccccggggccccaaaaggttgtaaagctatttgggggaccaggcttggagtgagccctgtgcctctgtggtccccacatcggggctcaatatgccctcttgtccccctggggaactcttggaagttgttcccaagtggccccacacattctcttaagttgtgtcctcg

SEQ ID NO: 374726 - DNA, 859 bp, Homo sapiens
tcgggggagcaaacaatagcgtagtacgaggctcggtggtgaattcggccgaggccctggccgtggcgaaagagccggcggagccggagacccgctcccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374727 - DNA, 960 bp, Homo sapiens
  misc_feature (895)..(895): n is a, c, g, or t
  misc_feature (898)..(898): n is a, c, g, or t
agcgggcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagttcgttnaanaaccaacaagacacaaacacccgcggacatataaaggggcgaaaacagggttcaacacaggc

SEQ ID NO: 374728 - DNA, 1154 bp, Homo sapiens
  misc_feature (943)..(943): n is a, c, g, or t
  misc_feature (964)..(964): n is a, c, g, or t
  misc_feature (1029)..(1029): n is a, c, g, or t
  misc_feature (1074)..(1074): n is a, c, g, or t
  misc_feature (1094)..(1094): n is a, c, g, or t
  misc_feature (1113)..(1113): n is a, c, g, or t
  misc_feature (1126)..(1126): n is a, c, g, or t
  misc_feature (1148)..(1148): n is a, c, g, or t
agcgggcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttggaacggcggcaagaggggccagaaccaccagaggagagccagggctaggagcaggaacaggatcagcagggcgatggccaggatggaaccgtcagaacagtgtgtggtggtgatgatgacagaactggagataaaagagaggccatcgntcatgctgacctggagtgcanctttcatgccaactcttttaagataggcgctggacacaagtaaataagtatctttcacagaaaanggcttctcattgagtgtgaccgagtcattgatcttgaagctgcanaaggaccctgtccacgttgngggcatgtcggaaagccgnttccttttacganaactttgaaatgactcttctgnacatat

SEQ ID NO: 374729 - DNA, 1040 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccggtgcgtacagcagcctggagcccagacccctgagaagggacacctgggttccacgggggtgctggagggcaggggctcaaagcctggtgctgaaggtgtctgagtactggagaatcccatcctttgccttcctcagctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374730 - DNA, 987 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagtgagttgggtggggtttagggctgggtccaaagtggggtgggttatctagtctcccttccttattgtgacattttcctgcaggaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374731 - DNA, 1102 bp, Homo sapiens
cttacacttaggagatttcaacttaacttgaccgctctgaccaaaaaaaaaaaaaaaaaaaaaaccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccggtgcgtacagcagcctggagcccagacccctgagaagggacacctgggttccacgggggtgctggagggcaggggctcaaagcctggtgctgaaggtgtctgagtactggagaatcccatcctttgccttcctcagctgcattcccctatgggtcggagcccggggcattgagtttgactggaagtacatccagatgagcatagactccaacatcagtctggtaggcagtcgtgctctcccacatacacatttctgctggcggccatactcctccccaaggcctggccccgactttctgcctccctctaggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374732 - DNA, 741 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaaggtgagggccaccgggaagccacgtgttctggcccccaggctctgcagacccaggggaacccgggcgcacggtgagctcatcccgcgcaacgcagacgccaccgaccggtgaggacacgacccaccgggacatcccagacacctatgaagagcgcgatcaggatacctagacgagggactgcgactcgaaaaagcaggcggcacgaaccagtgcaagcacagaagacccctagaacagcacaattggtagacgctagccaccactacggtaccagcctgaagcacaaccccgccgcaaaaacacacaaacacaaacacacgcaggtagaccatcacaatcaccgagggcaggaaacaagcgggggcaaagagag

SEQ ID NO: 374733 - DNA, 670 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaaggtgagggccaccgggaagccacgtgttctggcccccaggctctgcagacccaggggaacccgggcgcacggtgagctcatcccgcgcaacgcagacgccaccgaccggtgaggacacgacccaccgggacatcccagacacctatgaagagcgcgatcaggatacctagacgagggactgcgactcgaaaaagcaggcggcacgaaccagtgcaagcacagaagacccctagaacagcacaattggtagacgctagccaccactacggtaccagcctgaagcacaaccccgccgcaaaaacacacaaacacaaacacacgcaggtagaccatcacaatcaccgagggcaggaaacaagcgggggcaaagagag

SEQ ID NO: 374734 - DNA, 877 bp, Homo sapiens
cttacacttaggagatttcaacttaacttgaccgctctgaccaaaaaaaaaaaaaaaaaaaaaaccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374735 - DNA, 975 bp, Homo sapiens
tcgggggagcaaacaatagcgtagtacgaggctcggtggtgaattcggccgaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374736 - DNA, 808 bp, Homo sapiens
atattttgtcaccaagaccctacttctaacctccctgttcttatgaattcgaacagcatacccccgattccgctacgaccaactcatacacgccaggtagacctaaccatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374737 - DNA, 1120 bp, Homo sapiens
agagaggatggactttaaagagggcacgacctgagaagagacctagaagcaacttttgcgtagcacttagtaaaactgagaaaacctcagtagtgtggttggctaacaggttttttttggtgcggttaagagtgatcactgattccgtacgtgctgctaacactgcccaaggagcagcaccttcagacctgactcagatgccctgtgatcacccagaactcaaacttccagccccctcggggacccggggacctatcctctatctccccgattcctgtaattttgccaccatctggtggttcctcttccagatgggcccccagaacctgtcctgccctcttcctacccacgaacttcccacaaatcccacgtggtttatcttgatcccctcaccttgaagtgacctctttctgctttctgttctcagatgctgttcttggccactttctttcccacctgggaaggcggcatctatgacttcattggggtgagaggggccagggaagggaagggagttcaggaatggggctccctgtccccctgtgcttacttaagcctcaacctgacccgcaggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374738 - DNA, 1256 bp, Homo sapiens
agagaggatggactttaaagagggcacgacctgagaagagacctagaagcaacttttgcgtagcacttagtaaaactgagaaaacctcagtagtgtggttggctaacaggttttttttggtgcggttaagagtgatcactgattccgtacgtgctgctaacactgcccaaggagcagcaccttcagacctgactcagatgccctgtgatcacccagaactcaaacttccagccccctcggggacccggggacctatcctctatctccccgattcctgtaattttgccaccatctggtggttcctcttccagatgggcccccagaacctgtcctgccctcttcctacccacgaacttcccacaaatcccacgtggtttatcttgatcccctcaccttgaagtgacctctttctgctttctgttctcagatgctgttcttggccactttctttcccacctgggaaggcggcatctatgacttcattggggtgagaggggccagggaagggaagggagttcaggaatggggctccctgtccccctgtgcttacttaagcctcaacctgacccgcaggagttcatgaaggccagcgtggatgtggcagacctgataggtctaaaccttgtcatgtcccggaatgccggcaagggagagtacaagatcatggttgctgccctgggctgggccactgctgagcttattatgtcccggtgcgtacagcagcctggagcccagacccctgagaagggacacctgggttccacgggggtgctggagggcaggggctcaaagcctggtgctgaaggtgtctgagtactggagaatcccatcctttgccttcctcagctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374739 - DNA, 966 bp, Homo sapiens
cttacacttaggagatttcaacttaacttgaccgctctgaccaaaaaaaaaaaaaaaaaaaaaaccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtaggcagtcgtgctctcccacatacacatttctgctggcggccatactcctccccaaggcctggccccgactttctgcctccctctaggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374740 - DNA, 698 bp, Homo sapiens
tggttagctagggccacgagtcgtacccagcgggggagggcggaatcgatgactgcgtgggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtaggcagtcgtgctctcccacatacacatttctgctggcggccatactcctccccaaggcctggccccgactttctgcctccctctaggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcgctccaggttttagtgaagtaaacagtatttggaaagtt

SEQ ID NO: 374741 - DNA, 2115 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374742 - DNA, 2997 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374743 - DNA, 2891 bp, Homo sapiens
cactggcaacacccttctgtttcagctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374744 - DNA, 2924 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374745 - DNA, 3110 bp, Homo sapiens
ggatgcctcgcgcccgcggagagacgggcccgggacttgggaagagcaagctccgggatccagctcgggcgctgctgggttcagcgcccgagctgggctttgcaggctgagccgcgagccacttgtttgtggggagaatttacacccgcgacgagttcgagcttgaaggctcccgctgggcttgggctgcatggagcggggtccagcgctgcctggcggcttcacgcgaaccctgggcgcgtcccttgcggaggtgccggtgcctccctctgcagagaccaggagagagcctctgggcgttgggcggtgttgcccagatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374746 - DNA, 3067 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccggtgggcgtcctgggcagacccgcagcccccgcccgtgcccacgccctctgcgcccgcagcccccgcccgtgcccacgccctctgcgcctcagctcctgcctcccatagggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374747 - DNA, 2221 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374748 - DNA, 1617 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctacgtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374749 - DNA, 1716 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374750 - DNA, 2393 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctacgtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374751 - DNA, 2385 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtgggcttttccaagctgccactggtcggccagtacagcctccggaagcagccctacaacaacctgaagcacaagttcccatggctgtcggaggccgggctgcgcctgctgcacttcctgttcatggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374752 - DNA, 1627 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374753 - DNA, 2815 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcatggaggctgagctgcatccctgctccccacatggaggacccaacaggaggccgtggctctgatgctgagcgaagctataggctcttgttggataaaagcttttttaacaga

SEQ ID NO: 374754 - DNA, 838 bp, Homo sapiens
agggcacttggggacttgaagagctgctgctgcctctgcctccacctcccagtgtttcagcgagcttcagtgaggtggaattcctgtggtgggggcatctgctgggagcgggcagccccagggccgagagccttatgagggcactggtttcctgggctgttgggagcaggcagccccggggctgagagccttctgagggcactggtttcctgggctgctgggagcggggagccctgggcggagagccttctgagggcactggttttctgggctgctgggagagtgcagccccggggccaagagccttgtgagggcactggtttcctgggctgctgggagcgtgcagccccggggccgagagccttctgagggcactggtttcctgggctattgggactgctagtcctgctggccagtgtgggtgtggcagggcccagctgggcttccctgcaggctcaccctgactggtacctctgaccctctgcacaggtcaagtgcatcgtgctgcaggtgctccggggcctccagtatctgcacaggaacttcattatccacaggtgggtgacagctaggcagagttggaagcacaaattcggctgaggcctgactctgctgcccctgtggagttactaaaagctcaggggttcccagctgcagcagcctgcccgctgctcgcactccatttgtgtttttttctaaaatagagaaggggtctctctgtgttgcccaggctggtctcacacacttgggctcaagtgatccacccaccttggcctcccaaagtgctgggattacaggtgggagccaccacacccaggcatgcactccgatttttaaa

SEQ ID NO: 374755 - DNA, 311 bp, Homo sapiens
agcctcactgcggtggagaggcccctccccaggcacagccgctcggagtggccacctggcttcctttgagcatttgaatcacaggctgctcagctgggtgggaggtgaggaagccgcactcacaagtcgcactaacgcaggctgcctcctccagggcgacggccggggactgcctggagagctcctatttcaaggagaagcccctacgtgagtgtgcagggttcctgactcgctctgtggggtatggctgggagcccgttttgcccggggtgggtggtggagaagtggcctgctgccctcactgacggcac

SEQ ID NO: 374756 - DNA, 2959 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374757 - DNA, 3224 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374758 - DNA, 1787 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374759 - DNA, 2527 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374760 - DNA, 2979 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374761 - DNA, 2853 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374762 - DNA, 1751 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374763 - DNA, 2151 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374764 - DNA, 1822 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacaga

SEQ ID NO: 374765 - DNA, 3878 bp, Homo sapiens
  misc_feature (3019)..(3019): n is a, c, g, or t
  misc_feature (3022)..(3022): n is a, c, g, or t
  misc_feature (3024)..(3024): n is a, c, g, or t
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagaaaaaaaaaaaaaaaaaaaaaaaaaaaaaaaaaaaaaaaaaaaaaaaaaaaaaaaaaaaanaananaaaaaaaaaagaaaaaaaaacaaaaaaaaaaaaagaaaggaggcgggggcggcgcggcaaaactacactcccccgcggaccggccagcgcgacgacgcgacgcagcccacgcgcggggtaggaggggaaggaggagcggccgcccaaccagagaagaagcgaggtcagagtagataaacgtcagaacgcccaagagcgagccgccggcagctaaaaataaagagaggagagcaagaagcgcgagagaagcaaaagacgatagaagagtagcaagagccacaatacacagagagagagagaagagaaacagccacacagttcgacgacacgcgaataggcagagatgctgagacgagcagcgaacatatagaacgagagagaagaaagacagcacagacagtcgacacagactagacgcagtaggctgaatcagactactactgcagtccccagccagggcgcggagaggcaccgaagagtaggagagtcgtcacaggccgcgcggggacgaggggtggggatagatagtagttacggggctgatgtgcggctaagacacagacggaaggaacgtgagcgagacagatagaagaggggtaggacacaacgatatcgtaagatgatgcagcagcgagaacagtcgaggcttaaggtacacaggcacgagtctgacaaggtacgtgagtcgagaggagagagtagagcaacggagcatgaggaggtgaggagagcaggcgacatcagagcgtgaagccagtcagagagagaagctagcgcggaagaacccagcaggtaacgcaactgtagagatgacaacatgacaacaagagacgcgagccgctgaggccaagacg

SEQ ID NO: 374766 - DNA, 3082 bp, Homo sapiens
agcgtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggatttcggcctggcccgggcctatggtgtcccagtaaagccaatgacccccaaggtggtcactctctggtaagtccttctgaagcatggtggcccctggggaccaggcctgtctggtggaggtctccttggggatgtcaggccgaagctgcaactggccttgggaatgttaagctacagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggccgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagatcacagtaaaaaaaaactatgaaatacttcgagggggggggcccccggtacccaaattccgcccctattatgggagtgccgttattaccaaatttaactgggcccgtgtgtttttacaacacc

SEQ ID NO: 374767 - DNA, 842 bp, Homo sapiens
agcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacaggtgggtgacagctaggcagagttggaagcacaaattcggctgaggcctgactctgctgcccctgtggagttactaaaagctcaggggttcccagctgcagcagcctgcccgctgctcgcactccatttgtgtttttttctaaaatagagaaggggtctctctgtgtaaattgcctttatttttacagagtgatgttaggagctttctatactactcctcccttaaactcacagtagccatcattcagtgagcccaaatttaggggttagggctgaatttccgaatattggtaaatccttgctttccccatgggtggggtggcaatcccttcaaagccagggtatctcccagtggggctagaagagtggtggtgatgggtgggaccc

SEQ ID NO: 374768 - DNA, 405 bp, Homo sapiens
aaggtaatataaaggggaagagtctaagtgttgtgttggacagactctttgggtggtttccatgattcctgtttcctgatgttcatgcctttgtgtgatcctctcccttggagtatgtttgagacctgtgatttgcttgtaactatacaatacagcaaagtcacaggttgtacatgactatattgcatgagattttagtgccaattttgctggaatcttgcactctttactggcttcaaagacatgagctgctatgttaggagactcatgacaaggagctgaggacagtctccggatgaatccttcagtgctccccagtcaagcctcagatgagaccacagccatgctcaacctgtagattgaagccttatgagatcctaagcagaggactcagctaagccatgt

SEQ ID NO: 374769 - DNA, 425 bp, Homo sapiens
acccaataaacatcgtgtatgtgggagtatatagcattatggtatacagtacatgtcatgcatatgggagtgtattgcagtgtacctactcagacttaggtcagagaaggatttgagaatgtgacatataaaattgaaacctcaaggatgaaaataggcattcatagctgggcgtggtggctcaggcctctaatcccagcattttgagaggctgaggtgggtggatcacgaggtcaggaattcaagaccagcctggccaacatggtgaaaccccatctctactaaaatacaaaaattagctgggtgtggtggcacatgcctgtaatcccagctacttgggaggctgaggcaggagaatcgcttgaaccagggagtcagaggttgcagtgagctgagatagtgccactgcactccagtgtctcaaa

SEQ ID NO: 374770 - DNA, 2554 bp, Homo sapiens
  misc_feature (764)..(764): n is a, c, g, or t
actggtagagctcggcttcgtggctgtttcggagccaccgaaagataagctccctcgtcaccctgacatctctccgggaagactggaagggaaatggcctttcgggggatgttgaacgcatttgggcaggcggggagccaagcccggcttgagagcagagccggggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcntcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctgg

SEQ ID NO: 374771 - DNA, 2600 bp, Homo sapiens
  misc_feature (764)..(764): n is a, c, g, or t
actggtagagctcggcttcgtggctgtttcggagccaccgaaagataagctccctcgtcaccctgacatctctccgggaagactggaagggaaatggcctttcgggggatgttgaacgcatttgggcaggcggggagccaagcccggcttgagagcagagccggggacgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaaatgattgagtcccaggaaccagtgacatttgaggatgtggctgtggacttcacgcaggaagagtggcagcagttgaatcctgctcagaagaccctgcatagggatgtgatgctggagacctataatcacctggtctccgtggggtgttcaggtataaaaccagatgtaatctttaagttggaacatggaaaggacccatggatcatagagagtgagttgtcaaggtggatctacccagacagagtgaaaggccttgaatcttcccagcagatcatttctggagaacttttatttcaaagggagatactagaaagagccccaaaggataattcattgtactctgttttaaaaatctggcatattgataatcagatggatagatatcaaggaaatcaagacagagttttgaggcaggtcacagtcntcagtcgtgaaacattgactgatgagatgggttccaagtacagtgcatttgggaaaatgttcaatcggtgcacagaccttgctcctttaagtcaaaaattccataagtttgattcatgtgaaaatagcttgaagtctaattcagacttactaaattataacaggagctatgcaagaaagaaccccactaagagatttagatgtgggagaccacctaagtataatgcttcctgttctgtgcctgagaaggaaggcttcattcatactggaatggagccctatggagatagtcaatgtgaaaaagttctcagtcataagcaagcccatgttcagtataagaaatttcaagccagagagaaacccaatgtttgtagtatgtgtgggaaagcctttatcaagaagtcacagctcattatacatcaaagaattcatactggagagaaaccatatgtatgtggagattgtaggaaagccttcagtgagaaatcacacctcattgtgcatcagaggattcatactggggagaaaccctatgaatgtactaagtatggaagagcattctcccggaagtcacctttcactgttcatcagagagtccatactggagagaaaccctatgagtgttttgagtgtccaaaagctttctcccagaagtcacatctaattatacatcagagagttcataccagagagaagccctttgaatgcagtgaatgcaggaaagccttctgtgagatgtctcacctttttatacaccagataactcatactgggaagaagccctatgaatgtactgaatgtgggaagaccttccctcggaaaacacagctcattatacatcagagaacgcatactggagagaagccctataagtgtggtgaatgtgggaaaactttctgccaacagtcccacctcataggacatcaaagaattcatacaggagaaaaaccttatgtgtgtactgactgtgggaaggccttttcccagaagtcacacctcactggccatcaaagacttcatactggagagaaaccttatatgtgtactgaatgtggaaaatccttctctcagaaatcacctcttatcatacaccagagaattcatacaggggagaaaccttatcagtgtggtgaatgtggcaaaaccttctcccagaaatcactcctcattattcatctgagagttcacacaggggagaaaccttatgagtgtactgagtgtgggagggccttttccctgaagtcacatctcattctacatcagagaggtcatactggagagaaaccctatgaatgtagtgaatgtggaaaggccttctgtggaaagtctccactcattatacatcagaaaactcatcctagggagaaaacccctgaatgtgctgagtctggaatgacttttttctggaaatcacagatgattacatatcagagaagacacactggggagaaaccctccagatgcagtgactgtgggaaggcattctgccagcatgtatactttactgggcatcagaatccatataggaaagacaccttgtatatatgctgattgtgggaaggcctattcccagaagtcagtcctcattgtctatgggaaaactcacattgaatagaaatagtgacaacttctcaactgtagaatagactaatatgttcctcagtatacatgattacccttccacagaatgatctgcttaggccctcagaatattttcaacatcacaaatatggaatcaatttgctcaccctcaaactgtctcagccctcttcacagaataaatgtatctggaagaattagcactactttggtgttgtttggtcattaaatgctttat

SEQ ID NO: 374772 - DNA, 3499 bp, Homo sapiens
  misc_feature (8)..(8): n is a, c, g, or t
  misc_feature (89)..(91): n is a, c, g, or t
gacatcantacccagcccttgaaagatgagctgttcccgccgccactccagctctggcttctgggctccgaggaggggtggggacggtnnngacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaaaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgca

SEQ ID NO: 374773 - DNA, 4164 bp, Homo sapiens
  misc_feature (8)..(8): n is a, c, g, or t
  misc_feature (89)..(91): n is a, c, g, or t
gacatcantacccagcccttgaaagatgagctgttcccgccgccactccagctctggcttctgggctccgaggaggggtggggacggtnnngacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctttccgccctccaccaccttggcaaggcagccagatgcatctccgaagtccagctcactcaggccagctctct

SEQ ID NO: 374774 - DNA, 3942 bp, Homo sapiens
agctctcccatatggtcgacctgcaggcggccgcgaattcactagtgatctgagtccaaatgttctctccctggaagatatcaatgtttctgtctgttcgtgaggactccgtgcccaccacggcctctttcaggtgaggccattgtggttcaaggacgttaagtaacttccccagcgtcacacggcttataagtaaggcagccaggatgtgaacccagtaggactatctggctgcaaagtccccaccctccctcgccatctgtatcctccaatcatcttcagtgctttgctgatagaagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgca

SEQ ID NO: 374775 - DNA, 428 bp, Homo sapiens
ccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcatagctctagcatttgttacaactcccgaaacccccgagtttggtccctggggtaccgccttgcacactcagaagcctttgggaaggggtgctattcatttctgctcaatctgttaacaggcttctggcatgtagatcagtggtctccaagcttttgtgattgtatattcctataggaaaaaaagaattgattatgcatacccagtatgtatacttattaatctgtatgaagatgtacattctaaaatataatcaaccagtagaaatttaagaaagaagatgtaaaaaa

SEQ ID NO: 374776 - DNA, 383 bp, Homo sapiens
cactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctggagagctagaacctggagggctagaacctggagggctagaatctggagagctagaacctggagggctagaatctggagagctagaacctggagggctagaacctggagagctagaacctgaagggctagaacctggagggctggaatctggagagctagaacctggagggctagaac

SEQ ID NO: 374777 - DNA, 3921 bp, Homo sapiens
  misc_feature (8)..(8): n is a, c, g, or t
  misc_feature (89)..(91): n is a, c, g, or t
gacatcantacccagcccttgaaagatgagctgttcccgccgccactccagctctggcttctgggctccgaggaggggtggggacggtnnngacggtggggacatcaggctgccccgcagtaccagggagcgactgaagtgcccatgccgcttgctccggagaagcccaggtgtggcctcactcacatcccactctgagtccaaatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtcaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgca

SEQ ID NO: 374778 - DNA, 437 bp, Homo sapiens
gaattcttctcccatcttgtggttgaatatgctgagacagaggatattgtcctactttccacctcattcaagaagaagaaaatgctaagtatgaatttccagttttctccagtccctttcctgttgctaaatgaagatcattccatcattgtgtatcaaatgcagcatttgtgaaaatacctcccgatcatctttcacaggaattctttccaagtgagaaagccaccataaaagaagaaggccaccattgtatttatgaactatgccctgatatatttcaggaggctggtgaacactcattgtaacatttaagactttgtacaatttaatcacattcaggagtaatgaatgaagttaagactgacataaagcccagtattctcagcaggatggcatgtggcaaattcacagcaataaaataacaacatacattgaaa

SEQ ID NO: 374779 - DNA, 2737 bp, Homo sapiens
ggggattctcggagcactgtcgggcctactgggaccatggaccgtctccaccagcaacctagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaaaaaaaaccagcacaagaaatacaccagacaatacagagaaagaagaaaaacaccacgcacacacgcaacaccaccgcacaaccacaaacacacagcaaagacccacccaccacaccaccacaccaacacacccactccccaccccacaagcaacacgaccgccacacaacaccacaccccccaccgccgcgcccacacactaccacgagccggcacaccacgcagacgcaacaagtacgagccagccaacgaataaagagcgaccaaaagcccaaccacaacagagcatcacgcccccaggcagtcatccgtgccagtgctacgggtacaagatgggatcaaacaaatctgttataggagcctgacctcccgctgcgggcacaggtagactgtcattctcctcgctcggacatcgaccatagccactcttattgtcgtcgatgatgcatcatggcccgcataaatacttactacgtaacgcgtgagcaccacacaccaacgcggccgaacagtctattcacg

SEQ ID NO: 374780 - DNA, 299 bp, Homo sapiens
gagagagagagagagagagagagagagagagagagagagagagagagagagagagagagtctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374781 - DNA, 2781 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374782 - DNA, 2859 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtgaccctgcccctggtctcgggtcctgtgtctcaacctctcccactgcctaggcatcctgaccccagcttcccacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374783 - DNA, 3277 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtgaccctgcccctggtctcgggtcctgtgtctcaacctctcccactgcctaggcatcctgaccccagcttcccacaggtttctggccagctccgtctctatccctgggggtccccttacaccgcttggtctccaggtgagtggcctagcgtctcccgctcgtcaccaccgccacccacactcccctcactccgattacacactggcctccctggcaaggccccacctctctgtcctgggttcttcattgctgctgaacagacatggggttggtgtgggtgtgtgaggaaggaaagggtgtataacatgaagcagatgtaagagatgtgcttgatgggtgaaggaaggatgggtagatggggaagttggatgactggatacaggaagaaaggatggatttggtgtgtatgggtaatggctgagggagagaggaagcgaggggacctgagtgaagcctggatcatttcagttcactgggtggctgttcagtggctggttgggcatgcctgcctttgctgtcctccacccccactgcactgtcctctcccccacagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374784 - DNA, 2637 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaagtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374785 - DNA, 3303 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaaaaaaaaccagcacaagaaatacaccagacaatacagagaaagaagaaaaacaccacgcacacacgcaacaccaccgcacaaccacaaacacacagcaaagacccacccaccacaccaccacaccaacacacccactccccaccccacaagcaacacgaccgccacacaacaccacaccccccaccgccgcgcccacacactaccacgagccggcacaccacgcagacgcaacaagtacgagccagccaacgaataaagagcgaccaaaagcccaaccacaacagagcatcacgcccccaggcagtcatccgtgccagtgctacgggtacaagatgggatcaaacaaatctgttataggagcctgacctcccgctgcgggcacaggtagactgtcattctcctcgctcggacatcgaccatagccactcttattgtcgtcgatgatgcatcatggcccgcataaatacttactacgtaacgcgtgagcaccacacaccaacgcggccgaacagtctattcacg

SEQ ID NO: 374786 - DNA, 2313 bp, Homo sapiens
  misc_feature (54)..(54): n is a, c, g, or t
ctttgcctggtggcccgggcgccccctgcgccctgccctgccccgccgtggccngctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374787 - DNA, 2338 bp, Homo sapiens
gcggccgcctactctactaaattcgcggccgcgtcgactggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374788 - DNA, 2573 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagacgtcgggtggagcggtaccgagctcgattgta

SEQ ID NO: 374789 - DNA, 2924 bp, Homo sapiens
  misc_feature (2432)..(2432): n is a, c, g, or t
  misc_feature (2455)..(2455): n is a, c, g, or t
  misc_feature (2482)..(2482): n is a, c, g, or t
  misc_feature (2497)..(2497): n is a, c, g, or t
  misc_feature (2499)..(2499): n is a, c, g, or t
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctcccgaaaagaagntcttgtgagcagcccagacggangcccaagcccagggcaggaacctggancaaggacactttggncncagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374790 - DNA, 2866 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctcttctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374791 - DNA, 1689 bp, Homo sapiens
  misc_feature (219)..(219): n is a, c, g, or t
  misc_feature (228)..(228): n is a, c, g, or t
gcggccgcctactctactaaattcgcggccgcgtcgacggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctntgtccagtntacacacccacccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374792 - DNA, 1911 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggatggtccgcacagggcagcccgagtggccccaccagcaacactcacgatgcacttggctaggttgctggtggagacggtcatgtgaaacagattgggtatacaggaccataatctcagg

SEQ ID NO: 374793 - DNA, 1767 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttctctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374794 - DNA, 1855 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcagtctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374795 - DNA, 479 bp, Homo sapiens
  misc_feature (219)..(219): n is a, c, g, or t
  misc_feature (228)..(228): n is a, c, g, or t
gcggccgcctactctactaaattcgcggccgcgtcgacggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctntgtccagtntacacacccactctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374796 - DNA, 899 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgcctctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374797 - DNA, 1044 bp, Homo sapiens
  misc_feature (219)..(219): n is a, c, g, or t
  misc_feature (228)..(228): n is a, c, g, or t
gcggccgcctactctactaaattcgcggccgcgtcgacggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctntgtccagtntacacacccacccaggcttaactcatgccaactccaccctacatggctgccctgtgccctcgggataaaccccaagcccctgagcttgtgtttaaagccgttggccttgctcccccagctttgtcagctcagttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374798 - DNA, 2507 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtctcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374799 - DNA, 1184 bp, Homo sapiens
acaaaacaaacttttgttgccaaagggcaggtggctccaggcaggctgatggtggcaggtggggtgaggacaggacaagagatctgggtgtggaaggatggcctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaaaaaaaaaaaaaacaacaaaaaaaaaaaaaaacaaaaaaacaaacaaaacaaaaaacaaaaacaaccaaaaaacaaacaaaaaaaaacaggggggggcccccaaaaaacccccgcgggggggccccacaacatctgcgcgaccagaccagcgatcagaatatagttatacagagaacggcggccccacaaatgagacgcgagactcaacaataagacaacgccggagccccgagagcaggcagcgcccgcataacagacaaagaccaggaaggctgggggaaagaaccaacagagcaagcggaggaagaactaatgcaggggaaacggagggaccccaacacctcatcgggtgggtggacgaacacacacaatgggcggacagccacctcaacccccacgaccagcagttagagcccagcccgcccctaaggcgcgcgacgcacaacgacgccaacgaccccgacgcagggagctcaacagaggcggcggtacccacacaccacagccgcgcacgacaactctcgcggcccgggccgcacagaagaaacccgcttgcggcaccgcacgcggccacagtggaatactcgcgggaaccgacacaacatcttatacgaccaacgggccagcgccgatggagcaaaagacgagggagcgccagcgaccaggcagacgcccgacacgcgacgcccaccacacgaccagacccgcgaacgcaaaccacacacagccacgacagccgcacccgctgaaccgcgagcagcagagacgaaacgagagcgccagagccagacgcaccacaggcacgcagcgagtcgcccagacagcagcccgaccaccaccagaacgaacgcaaacaaggacggatgacgcaacgcgcagaacgacaacggcgaccacgacc

SEQ ID NO: 374800 - DNA, 3199 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccaggtgagtggcctagcgtctcccgctcgtcaccaccgccacccacactcccctcactccgattacacactggcctccctggcaaggccccacctctctgtcctgggttcttcattgctgctgaacagacatggggttggtgtgggtgtgtgaggaaggaaagggtgtataacatgaagcagatgtaagagatgtgcttgatgggtgaaggaaggatgggtagatggggaagttggatgactggatacaggaagaaaggatggatttggtgtgtatgggtaatggctgagggagagaggaagcgaggggacctgagtgaagcctggatcatttcagttcactgggtggctgttcagtggctggttgggcatgcctgcctttgctgtcctccacccccactgcactgtcctctcccccacagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374801 - DNA, 2652 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacagaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374802 - DNA, 3137 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374803 - DNA, 2636 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggcgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374804 - DNA, 2215 bp, Homo sapiens
ggggattctcggagcactgtcgggcctactgggaccatggaccgtctccaccagcaacctagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374805 - DNA, 2720 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaaggtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctgggtaagccggaagcagggtgggcaggagaaccccagctgggcctctgcccacttcagctacctcactctctcaccccagcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374806 - DNA, 2605 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccacccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374807 - DNA, 1890 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccctctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaa

SEQ ID NO: 374808 - DNA, 1940 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccagtgtctttgagctgcagcagctggttgaggggcaccaagaatcctacctcctctgctgggaccagtcacaaaaccaggtacaggtagttctgaaccagaaggcaggccccaagaccatcctaagggccgccacacatgggctgatgcttggggccctgcagggagatggaccccttccagcagagctggaggagctgaggaaccgggtgcgggcaggtcctaagaaagagagctgggtcgtcgtcaaggagacacacgaagtgttggacatgctgttcccaaagttcttgaaaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggtcagcatccaggtcctcccgttcctccttgctatgccggagactgaagaccaggcggtggaggtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374809 - DNA, 1812 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaagtgcatcgtgagtgttgctggtggggccactcgggctgccctgaccgtgcaccaggctcggaggaacaacatggctgacgtgtcagccaaggacagcagccaggagacgctggtgaacctggcggggctcttggtcagcctcctgatgctccctctggtgtcaggttgccctggcttcagccttggatgtttcttcttcctcactgccctccacatctacgccaactaccgcgcggtccgagccctggtcatggagaccttgaacgaaggccggctccggctggtcctgaagcactaccttcagaggggagaggtactcgacccaactgcagccaatcgcatggagccgctgtggacaggtttctggccagctccgtctctatccctgggggtccccttacaccgcttggtctccaggtgagtggcctagcgtctcccgctcgtcaccaccgccacccacactcccctcactccgattacacactggcctccctggcaaggccccacctctctgtcctgggttcttcattgctgctgaacagacatggggttggtgtgggtgtgtgaggaaggaaagggtgtataacattctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgccaggcccatcagcaggcccccgatga

SEQ ID NO: 374810 - DNA, 754 bp, Homo sapiens
gggcggggctgggatccaaaagctcggcatggctgacgacgcgggtttggagaccccgctgtgttccgagcagttcggctccggggaggcacggggctgccgcgccgccgcggacgggagcctgcagtgggaggtcgggggctggcgctggtgggggctctccagggccttcacggtcaaacctgaaggacgagatgcgggcgaagtgggggcttccggggccccctcaccgcccctctccgggctccaggccgtgttcctgcctcagggcttccctgatagcgtcagcccggactacttgccctaccagctgtgggattccgtgcaggcgtttgcttccagcctctccggctccctagccacccaggcagtcttgctgggcataggggtggggaacgcaaaagccactgtttcagctgccacggccacctggctcgtgaaagattcaactggcatgctgggccgcatcgtctttgcctggtggaaagggagcaaactggactgcaatgccaagcagtggaggctttttgcggacatcctcaatgacgtagccatgttccttgagattatggctcctgtatacccaatctgtttcaccatgaccgtctccaccagcaacctagccaaggtagctgcctgtgggggcacccatctgcctaaaacacctgccttggtagtgtgtgagtttacctgggctctgtgagtttacctgccacttcaagaagaataagaaagttcagatgtttctactcga

SEQ ID NO: 374811 - DNA, 390 bp, Homo sapiens
gaaattagggcattattggatagtgtgatgcatagatacagtttgttaatttacttcagatgaattgataaaatgctgtatgatgctgaatcctgacttacacagttgctgaaatgacactcccttattcaaagaaaatacatttctaaatgtgcaaggttaacaaaaatggtttgaaaactgttggtgatgtattttttaaaagtatagagtagaaaatatactttttatcttatagttatgattgtgatatagagaattctttgagatcttttgaccctttattttagtttattagtatgttgtaaaaagtatgttaacttaagcaaaatcagttcagcttttaactgcgttgctggtaacaacttagtatttaacgtagaactctgt

SEQ ID NO: 374812 - DNA, 362 bp, Homo sapiens
aagagccaggaacgataagggaacaaacttcatattagagtaaacgtgatttttccaatacgctcatagtatgctatcattcccaattaccttcccaactgcacttctcatataatgtatttgggaggccgaggcaggcagatcacttgaatcaggagttcaagaccagcccggccaacatggtgaaactccgtctctaccaaaactataaaaattagctgggcatggtggcaggtgcctgtaatcccagctactcgggaggctgaggcaggagaatcgcttgaacccgggaggcagatgctgcagtgagccaagatcacgcaccgtactccagcctgggtgacagagtgagactctgccac

SEQ ID NO: 374813 - DNA, 640 bp, Homo sapiens
  misc_feature (1)..(1): n is a, c, g, or t
  misc_feature (62)..(62): n is a, c, g, or t
nggaatgggaggcctttattcttaaattaaaaccaacaaaggggggaaaatggaaaagtatnaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374814 - DNA, 2490 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374815 - DNA, 3485 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374816 - DNA, 3301 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374817 - DNA, 2872 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374818 - DNA, 3026 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374819 - DNA, 1898 bp, Homo sapiens
  misc_feature (1)..(1): n is a, c, g, or t
naacttaggctaggtacgaggctgggtgttggtagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374820 - DNA, 2435 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggttgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374821 - DNA, 2514 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttacaaagttacaaccatttgcttccttaacatggtgtatctttttgcttatgaatattctgtattataaccattgtttctgtagtttaattaaaacattttcttggtgttagcttttctca

SEQ ID NO: 374822 - DNA, 1992 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374823 - DNA, 2374 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374824 - DNA, 2097 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374825 - DNA, 2450 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374826 - DNA, 1537 bp, Homo sapiens
  misc_feature (25)..(25): n is a, c, g, or t
taaggtctaggtacgaggctgggtngtgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374827 - DNA, 1814 bp, Homo sapiens
  misc_feature (1807)..(1807): n is a, c, g, or t
  misc_feature (1812)..(1813): n is a, c, g, or t
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactaaatgtcccccaattggaactggatgtgggtaaaaatataaaaatattaaaagaaaaaaccgtatgcgggnccgcnna

SEQ ID NO: 374828 - DNA, 2503 bp, Homo sapiens
  misc_feature (2503)..(2503): n is a, c, g, or t
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcaaaaaaaaaaaaaaaacaaaaaaaaataaaaaaacaagaaaaacacataaaaaaaaaaaacaataaaaaaaaaaaagaaaaaaaaaaaaaaagaagaaaaaaaaaaaagaaaggggggggggggggataaaatatttccaggggggggcaaataggggccccccccatttggttggaaagaggggctcccactgggggggtatttaataagagagcgggggggggtaaaaacacggtcgtaagacaaatactaagtgtgtatagtagggaacaccctcgtggcggggggcgaatagggcaccacacagcaatacggagcggcggaataaaaatgtagtggtggtgcacaccgcctttctgccgtgttctttttttttttcataaatcctcctcattgtaaacaagagagaagcacaggaggaggggcacgcacgtcagagctgcgtagagaagataaataaagtagagacaacgcggaaagaaactaccgacgaactgctctggtacactcn

SEQ ID NO: 374829 - DNA, 2765 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaaccta

SEQ ID NO: 374830 - DNA, 2443 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacgggccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374831 - DNA, 1875 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaaccta

SEQ ID NO: 374832 - DNA, 2430 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgaactgacaagtaaacgtgttcctctgctgtgca

SEQ ID NO: 374833 - DNA, 2021 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactattgttttgacaattcaaacctggattgtgataacctctaaattttggggggcctttcttggactttttaacagggaaaaacctttgttcaaatccaattaccactacaggtcttaaaagcttggttcaagtatttgacatttgccaattgcctcttcaattccttaatttaccccctct

SEQ ID NO: 374834 - DNA, 1540 bp, Homo sapiens
ggcggcctgggcgggagcgcgcgggcggggccggccccgctgcctggaattaaccccgctgtgcttgctcgtcccgcccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374835 - DNA, 1464 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcgtcctcaatgctgctgttataagatattgccagtt

SEQ ID NO: 374836 - DNA, 1516 bp, Homo sapiens
  misc_feature (1458)..(1458): n is a, c, g, or t
  misc_feature (1462)..(1462): n is a, c, g, or t
  misc_feature (1472)..(1472): n is a, c, g, or t
  misc_feature (1481)..(1481): n is a, c, g, or t
  misc_feature (1483)..(1483): n is a, c, g, or t
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggttcggcangcgngtacggggantggggaaangncccttgcagagaaagctggaagcaggtttgacg

SEQ ID NO: 374837 - DNA, 2515 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcatctcagaaaataacaaagctctatt

SEQ ID NO: 374838 - DNA, 3208 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374839 - DNA, 2595 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374840 - DNA, 3001 bp, Homo sapiens
  misc_feature (3001)..(3001): n is a, c, g, or t
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcaaaaaaaaaaaaaaaacaaaaaaaaataaaaaaacaagaaaaacacataaaaaaaaaaaacaataaaaaaaaaaaagaaaaaaaaaaaaaaagaagaaaaaaaaaaaagaaaggggggggggggggataaaatatttccaggggggggcaaataggggccccccccatttggttggaaagaggggctcccactgggggggtatttaataagagagcgggggggggtaaaaacacggtcgtaagacaaatactaagtgtgtatagtagggaacaccctcgtggcggggggcgaatagggcaccacacagcaatacggagcggcggaataaaaatgtagtggtggtgcacaccgcctttctgccgtgttctttttttttttcataaatcctcctcattgtaaacaagagagaagcacaggaggaggggcacgcacgtcagagctgcgtagagaagataaataaagtagagacaacgcggaaagaaactaccgacgaactgctctggtacactcn

SEQ ID NO: 374841 - DNA, 2436 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgtcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374842 - DNA, 2309 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgaattcgagatccttagagtcacctcagcatcagc

SEQ ID NO: 374843 - DNA, 2987 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374844 - DNA, 2054 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaagtgctacaacgtggggtaactggttatgttatacctcagaattaagggtatttgaccaattggttaggacttcgggaagaatgactttgaagggtgtttaacaaattaactcactatgttgggcagagcaagttaaaggtagtgtatgggtgaggaagagtcgttccaccgttgtgtaagaggatg

SEQ ID NO: 374845 - DNA, 1770 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaaccta

SEQ ID NO: 374846 - DNA, 1781 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgacttacccgcgtgtttgttaatacagtatgcccccccccctccctcca

SEQ ID NO: 374847 - DNA, 1936 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagccactgatctttttattgtctctgtagttttgccttttccagaatgtcatatagttgggatcatacagtgtgtagccattttagactggcttctttcacctagcaatatgcatttcaagttcttttcattgctcaattctttttatcactgagtgatagtccattgtatggctgtaccacagcttgtttatccattctcctatgaaaggacacctcgattgcttccagtttttgacaattatgaataaaactgctatagacactt

SEQ ID NO: 374848 - DNA, 2818 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctataaaaaaataaaattataaaaaataattggccgcggtttacacgtcggaatgt

SEQ ID NO: 374849 - DNA, 2341 bp, Homo sapiens
gtgcgacggtggatgctcccggagtggaggccgggtgtggtcacgcaggactgatctagagatcagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374850 - DNA, 2799 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagttgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374851 - DNA, 2023 bp, Homo sapiens
aacgtagtcccgggtggcctggcacgcgcaagcgctcggcggggagtccccaccgccaggacgcagagccgacggagctctcgggctctggcgaaagggggttgggaagcggactccggcgaagagcagtcaggaacggctggacggggccgagagacgacgcagcggagtctgagggggccggggtcacagggagaggcaaatgagggcagaagcactcttcagacggagacggggctgacggctgagcaaaaaaggggcgtgaacttggagtattggcatgaaaaaaaggtgggggcccagatggggagcacctcctcttcctcctgcccaatcgcgatcgtccggcctcccaggcggaaaaagcgtttcgcgggctttccaactgcccgctaattccgctccccctccctccagccgtgactccgcgctttttggcccgcccgccgggctgtgcgcaggcgcttcgggtaggggcggggcgcgcggcagggtcgttacgaagcggggcgcggtgggccaatcagaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggatcgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttaactttggagcagccattagtacagccattaagcgag

SEQ ID NO: 374852 - DNA, 1357 bp, Homo sapiens
agctacatacactctaagtctggggcccgcgctcgttctcgtatctcagtctagctctaagtgcagatccggacgatccgtcctacattacatagtcgctctgtcagtgtcttccacgaatcatcgataacgcgcgcgcgcaggggtcacccggatgctgctgtgctcgcaagcggagaatcctccactcgcgaggtgtcccgaagggatgcggtaatctcgaggatactcatcgatcgacggaatgctgacagagctgcaccctccaatgtttcctggaagacggcacggccccgggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcggcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctca

SEQ ID NO: 374853 - DNA, 1221 bp, Homo sapiens
ttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgtgtaagtcaaaggaattgtttcctctgtcacaccataagaataatggaagactattttttgcatccttatcttactagcactccctgctgcactttacactgtagattatacctttttcttcttggaacgctcatcatctttggcatccaaaataacattcttctaattctgttatggctactcttaacatttttgtttcatttgtggtctctgtgcatcccttaaatgcctttcgtccttaggttttccagaattccatacttgaagttcttcctctcttctccctgatttcattggccctcgtagtgtccactaccagctatgtgatgttactctcagatctccatttctggctttt

SEQ ID NO: 374854 - DNA, 1100 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagggtgaagtggcagatacctgcctttctttctaggttgtatctcccacttcacccttctagatcttctgggttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgacccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctactggggaagctgcgggcacccatccgctccgtgacctacacctggccagctccctgcgcctccatggctctgcagatcctctgggaagcggccgccacctgtgaccagcagctgatgcctccttggcaccagaccatgcgccaagagccggcgtggctatacctggggacttgatgttcccttcagaattggggtgggccctgaagtcctcggttccctggcggcttgtttgccgtgtgggtctctgggcgcagtggcctgtgtgtgtgccccgtgttgttcttgcg

SEQ ID NO: 374855 - DNA, 2038 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374856 - DNA, 1860 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374857 - DNA, 1916 bp, Homo sapiens
aaaaaaaaaaaaaaaataatcatagacaagaccgggtgtgtaatcagagcgaggctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374858 - DNA, 1880 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374859 - DNA, 2416 bp, Homo sapiens
ttttttttttttgtatttttagtagagacagggtttcactacgttggccaggctggtctcaaactcctgatctcgtgatctgcctgccttggcctcccgaagtgctgggatcacaggtgtgacccactgcgcccggccttatctgtctctttaagatcctattgcatttgggatcctgtagtattatgccactgcctatttacctaataatatatattgaacatctttccatgtcagtacacagatctctgcttaattcatttgaatgttcttctgtagtattcatacataatttatgttatcattttcctgttgaagaataggtaggtgttttccagttcttcagtattgcaaacaccactacattgaacatctttgtatccatgtgcaaatattcccgcaacatactgtgctagctgttcagccacatcacctttatgaaattctcacaggaacctgtgaaggctataggtaatttgccacattccacagatgagaaaaaggctaagagagcttacatgtcttgcctgaggtctcacaactcataaatgacggagcctaattgaagtaaagatctgtctgacagcagaactcaagtattttctctgataccacgatttacaattgtggtatatgattcatatatgtgtttaaatgtaaacatataaaccacatgtttataaattactcattttttttctttttcttagatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374860 - DNA, 3156 bp, Homo sapiens
ggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374861 - DNA, 2401 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374862 - DNA, 1836 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374863 - DNA, 1758 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374864 - DNA, 2044 bp, Homo sapiens
catgatttctgtattcttcagtttctcttgactctgtcatcatcctaattcaggcctttctggactaatacaagaacctttactgttactcattttgcccttagtcaattaaatataaccttccctattccatattgtcatttctcctgttcaaaagtcttaaatttcaactccactgtcttttatagtttttcatttaattccttctttcttgaaaattgctttcctatcttgtgagtggcatcaacagagtaatttatgggtagttgtgatgagtatttgggtgagatgagagtagtggctggtagtgaggatcagagagagggaaaggaggtaaaaaaataaaaaatcacttataaagggtcctgaaataggatttgaaatccagattttaagggagttagaatgtgttattctctgatgggcctttatgaaacatagttaaaggttgccatagaaaacaaccaagtaaaatattttatatattacagtggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374865 - DNA, 1642 bp, Homo sapiens
actacatacttccgggcacacttccggactacatactccgtatctgggaaatcactaggagttcttggaagggggggaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374866 - DNA, 2676 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaaaaaaaaaaaaaaaaaaaaaaaaaaaaaaaaaaaaaaaaaaaaaaaaaaaaaaaaaaaaaaagggggggggggataaaaaatagggggggggcataaagacgcgacccgcgccgcttgttcgtaagaacaacaaggcacccccaacaatgaggacggatagtagtaaacgaaacaaggacgggaggcgtataaaaacaagagggcccgagagaagagcaaaacaacgcatacgtgccacccttaagcagagacgcacccaacaataccttgggtggaggaaataacacaagtgagggacccaacacccagagaaataaagaccccccggcggagaaaacacaaaaagaagtggtacagagtggtaacacacagactgtatactgactcaaacaaaaaatctgctccggagaagataacaagaacaaatctctcagggggcctcgtcaaaccagggaggggccgacgaaacggacccggcgacagaccagaatgaagacaacacatcgcagaggagcatcgaagcccagacgagacgtagcgacggaggaggaaccacgacgcgcactgaacgacacataacgatcaaaacgaagtaaagacgagacgaaacagaagaccagacgtagacgagaacaaaagcgacgtgcgagagcagcaacgaagtagaaacgaagcagaggagcatac

SEQ ID NO: 374867 - DNA, 2588 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaaaaaaaaaaaaaaaaggggcgccgtctcgaatttaaaataggtcctcgccttggacagacaacactttcttgtgtacattaaccacatcctgctcggaaactcggcgcgttacacagtctcctgtgtaaagggccgggcgcatggctatcaaggagctgttggccgggaaacgcctgtgctgcggcatcccctggctgggattctggtgtgaggcctcatgggcttgtgtgagcacccaggattaatttactaaaaaaggggccggaatattttccacattccattggtgactcccatttttttggtcttctttcccaactccgttgaccctttggtccgcatattctttacgaggggcaaaatttgctgttggacacttcttggcctggagggggtcttacacacacgcggggatatctgtggacgctaagacgtacgttactagaaagtgcctgttttcaaaccgaaagcgagggacctaatgtttaggttaaaatagaacgttcgggcgaacctggtacgtccaaagtagtcgttggtagacgtggcgtcagagaaacgggcactacgtgcgcgcatctaccttatgcccgcattag

SEQ ID NO: 374868 - DNA, 1679 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtacgttctaacatgatagaggcaatgcattattgtgtagccacggttttctggaaaagttgatattttaggaattgtatttcagatcttaaataaaatttgtttctaaatttcaaagcaa

SEQ ID NO: 374869 - DNA, 1288 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374870 - DNA, 510 bp, Homo sapiens
cctagttttagaagtttcaatagcaatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374871 - DNA, 794 bp, Homo sapiens
  misc_feature (1)..(1): n is a, c, g, or t
  misc_feature (111)..(111): n is a, c, g, or t
nctagttttagaagtcatagcagctttattcataacagtaaaaaacaagcagaaagagcccaggtccatcagcagaaagataaaaaaacaaactgtgatgtattcatacgnaaagaatactcagcaataaaaagaaatgaatcactgacacatgcaacaacatgaataaatctcaaaaacattatgctattgaaacttcttagaactatctacttatcaagccatgaatcctcaagatcaaaatacactgctcaaccggagaagtggtttgacctaaatgttttagtttctggagagaaattcaggagcacctagctacttcattttcagtaagaacaatttttattgctttatttattggacgaataaagtactgtttcaggctattgaaacttctaaaaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374872 - DNA, 2030 bp, Homo sapiens
ggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggtaagtgcctcccttctgtcctcagttctcaaacaggataataccacataaccttcctaactgtccaggaatattttgaaaattaataagctcctatctgggaaagtagtctaaattctgagaagggaagggtggagctaagtccattgatagttccagtatagaaagtgcataagcaacagagggctttgtaatcttacatcccttgataaaagatactacagtcaatctcctgtagtagttccacagttccatagattacatttttccttggagcatcctatatgcagcatagtttagtggttaagagcaaatacttcctgaatttaaatcctggctctgccacttaactatgtgatcttgggcaagatatttactcactttatacctaagttcctcgtatatgaaacagaggtgataataatagttcctacttcataggattgttgagaggattacatgtaaagtaccaggacagtgcatggcacatgtaagtatttgctttaataataattatggttctgttagtcctgataatctcatgttttatctacacatttacacctacttctaaaagcagtggatatatttctttttggaattgtgtaaaaaaaaaaataataattaataccgttggtttctctcctcattttccagaagcagcagttaccactagaactgaattccgaaattatgacttctggcttgtcttaacaatctagaaaggtttcaaatatattgatcatatttatttatgagggaatttccaggagctataattttagctagcagttcaaaccaaatttataaataagcaaatcttttcactgaatattcagtctgctaacagcttttgtatcattcctcctttgtctcagacttaaaaaaaaaaaatctattacatgtaatggaaatgtttcaagatccagaagagaaaattgatatgaatgtaactgatatggtatatgtgcatttaaaggtttattccaacaaaatgttactcacactcttttctgacacatgcatacacaaaagatgttagcatttgcagtctgattcccaaatggccc

SEQ ID NO: 374873 - DNA, 1989 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374874 - DNA, 1938 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374875 - DNA, 1911 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374876 - DNA, 1958 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374877 - DNA, 1960 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggattgttgagaggattacatgtaaagtaccaggacagtgcatggcacatatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374878 - DNA, 2615 bp, Homo sapiens
ggggggagtgcaagaaagaaagagatggagaacgagagcgagctggagatgaaccacatgcgatgagtaggccttgtttggatcctgaatcgaacacaccaactgtaaaaatatgtttaagacgcatcgggaaaattgggacacggattcgatatttgatgttttttagggaattgatgtcagtttttttaggcgtcacagtagtattgtgattatgttttcaaattgtccttttttgtagagacatacgaaaatatttacggattaaataatgtctgggattggcttctaaatacattaatgactaggatttgcttcaaaataatctcagcggtagggggaaatggggaggggtatagatgaaacaaaattggccctaaattaataatatttttttgctgagtgataggcagtgggttgcgtatattaatctgctttccttggtatacgtttaaatttttctataataaaatacagaagtcagatattccggtgagcttgaaaaagtcgggggtgggggggagcagtgggtggggttatagatgaaacaagatggccttcagttggtaattgttgaaagctggatgatggattcgtgtaggtttataatactatttcttttttatttcatccatttgaaattatatttaaggaaagttaaaaaacaaatttgtcagaaattatacaaatgtacaataaattaaatttgaaaatgtggccacaagaaaggaaaaagaaacacttgtacattatttatcagctttggtgtcctttgtgtgtgatgaaattgcattggctgatgtagaagaaagccatatctcatatctttttattttatgttctttcttgtccttttgtttgaccttctaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374879 - DNA, 1965 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374880 - DNA, 1848 bp, Homo sapiens
cagctaacggagagataccttgacggatcgcgtggaaaaaatcgctccttccgatacagacatatcgagcaatctcgttcagagtcaccatcagaaaagctaagtttgctgtatagtgaggatcaggagatctgatcctgattgcagaaccttccctgattacagaatcttggatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374881 - DNA, 1938 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374882 - DNA, 2017 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaaaaataatttaaacaatgcatttcatgtt

SEQ ID NO: 374883 - DNA, 1747 bp, Homo sapiens
atctagtggcagactcgagaggtataaaccttactcacagaactttcgggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccgaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374884 - DNA, 1935 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataattagaacaaagaagaaacattcagtagaacattttattgcctagttgacaacattgcttgaatgctggtggttcctatccctttgacactacacaattttctaatatgtgttaatgctatgtgacaaaacgccctgattcctagtgccaaaggttcaacttaatgtatatacctgaaaacccatgcatttgtgctcttttttttttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374885 - DNA, 1931 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttggatgatttcacaaaagttcatcttcattgcagatacctgcctttctttctaggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagccccctcggaagaaaagggcccgggcagaccccactgttgaaagtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgccagtgattacaaagtggcttctgctgagtaccaccgcaaagccctgtgagcgtctacagacagctcaccatttttgtcctgtatctgtaaacactttttgttcttagtctttttcttgtaaaattgatgttctttaaaatcgttaatgtataacagggcttatgtttcagtttgttttccgttctgttttaaacagaaaataaaaggagtgtaagctccttttctcatttcaaagttgctaccagtgtatgcagtaattagaacaaagaagaaacattcagtagaacattttattgcctagttgacaacattgcttgaatgctggtggttcctatccctttgacactacacaattttctaatatgtgttaatgctatgtgacaaaacgccctgattcctagtgttttatggtgcttgaagtaaaacagcccatcctctgcaagtccatctatgttgttcttaggcattctatctttgctcaaattgttgaaggatggtgatttgtttcatggtttttgtatttgagtctaatgcacgttctaacatgatagaggcaatgcattattgtgtagccacggttttctggaaaagttgatattttaggaattgtatttcagatcttaaataaaatttgtttctaaatttcaaagcaa

SEQ ID NO: 374886 - DNA, 716 bp, Homo sapiens
atcatttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaaccttccctgattacagaatcttgggattgttgagaggattacatgtaaagtaccaggacagtgcatggcacattggttggaataaaaacagggttgaatgagttccagaaagcagggttctcaacctcgtggacagcaatctgcagaagaagagaacttcaaaaaaccaactagaagcaacatgcagagaagtaaaatgagaggggcctcctcaggaaagaagacagctggtccacagcagaaaaatcttgaaccagctctcccaggaagatggggtggtcgctctgcagagaaccccccttcaggatccgtgaggaagaccagaaagaacaagcagaagactcctggaaacggagatggtggcagtaccagcgaagcacctcagcccccttcggggacaggaaaacaatgggtccccgggggccaaggaacccccaacttggtttgacacacgtga

SEQ ID NO: 374887 - DNA, 5339 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374888 - DNA, 5482 bp, Homo sapiens
ttcttgctctccatcctttgagggagctcagggacatttcgggattctggatttcttggtctgcaactccctgtgtgccaggcggggctgggccccgctgcggctggctggcgttggcgctctcatcgagggagcgcttcgctttgaaatctacccactcctttttttttttttttttaaaccaggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374889 - DNA, 4838 bp, Homo sapiens
gatctctatgatgatccccggcctatcgtggatctgcccgtgaccctcgtgagagaatttatagagcggcagcacgcaaagaacaggtattactactaccaccggcagtaccgccgcgtgccagacatcactgagtgcaaggaggaggacatcatgtgcatcagtcgcaagaagctggggcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374890 - DNA, 4648 bp, Homo sapiens
acctgcagccctggctggaactacctgagagttggagccagaccctgtctgtccctgacctcggacaggtgcaggtggggagtggggcctggaagagacactatggtcagtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374891 - DNA, 1191 bp, Homo sapiens
catccaacgccgcagtgactgcatccaacgccgctgactgcatccaacgccgctgactgcatccaacgccgctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374892 - DNA, 807 bp, Homo sapiens
taaactatgtcgtcagcgtggtgggtgcacagcaaatccatctgtgcagagcctatcttcccagtctcttcttacagctgatggagatgactctactgcaaaaatgacaaccagcaagaaagcgggtggtgcccgtttcctccctggggaccctcagagggccaggccattctcttccttggtgtgactgcggatccagggtaagaagtgtgagactctcgtgtagacgcctggcttgtccttcagggcacatccatgagagtctccgtcgaactagttcgacggagactctcccctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374893 - DNA, 603 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaagtccgcagggctgccaaggcagagacccggggttgcgggttcggggattgagctccggggtctgcgggagcggccgcc

SEQ ID NO: 374894 - DNA, 818 bp, Homo sapiens
aggagaaaaggccctggtcagaacctggctttagcaggcagctgtggcagaagcagttcttagcgaaggccgaggaattgttagatgctccataggcggtgctgtgtcctatcaggagaactgagaaaagtccactgggtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcggtacgggctgggcagctcagggcc

SEQ ID NO: 374895 - DNA, 4235 bp, Homo sapiens
aggctcggcctcaccttaaccgcgtacctcacctaaccgcgctaactggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374896 - DNA, 4167 bp, Homo sapiens
tgcgctccagctctgccaggcaggggggcttctccctccagaagcagaagcaccactcagcagtagagacccggccatccttgtaggtgtcacaggagttgaagaagggacggatgctgacctcttcctggaccagacggagctggccgccatcaacctggacaagtacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374897 - DNA, 3711 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgcctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgctcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374898 - DNA, 3454 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgccctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacaccaaaaaaaaaaaa

SEQ ID NO: 374899 - DNA, 1291 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggagttccctcgtccgacccacccagtacaacgcaggccacaccatgacctctcccgttttctccttaaactgcgtgcatccacaagttccttggaaatttgtttaaaacacacatgcttcataggctatccagccaagtgatgggaagaggcagagatttggatctttttgttaccgtcagacaagtgactgtttctccccaaagtcaaactggcaggttgtaattcacagaggacagcaggaaccacgggcagccaggtctccaggctgagtggccgggccccgcgatgggctgctgatctccgccttcgccccacatgcgacctgtccagccgcaggagcctggagccccgcgaggccttcccgaagcacctgcaggcccagcgcagatgagccgcagtctcctgccgcttcctgggcagcagcccggccacagcagcgagggggcggcagcaggccggcccatccggaatccatgtgtcactggcctaggcctccctccgactcgctggctgtttgatctgccaaaatgggaccagtgaaggtcagagggaaaagaaatgcttaatcagaacaggaaaggtttaaaataaaagattcctccccacctcccttcttccacctgcttccaatagccagctccgtgggtgagaataaatgacttactgcttgaccccatggcactgggctacccacctgtctctctgtattggtgccaaccacttcccccttcctctcatgctcatcagaagaaaggcactagatttga

SEQ ID NO: 374900 - DNA, 960 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagaggtatttttcgtgtaaacttgcttcctagcgcagtaatttacaaatacttgtcaatgatttagactgctgtgaattcgcctgtatgtatcgttaaaaaaagtcactttgccctcagtgaaagcttgaattatggggcaaacaataatgaacaccttatgttttttatagtgcttcatagtaaaaaa

SEQ ID NO: 374901 - DNA, 2002 bp, Homo sapiens
  misc_feature (1356)..(1356): n is a, c, g, or t
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttccttnccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgta

SEQ ID NO: 374902 - DNA, 386 bp, Homo sapiens
catgggattgaaaagggcacatcatgtgatgtgacagtctttctttggtttccattcaggatttcttacaatctccagctacaacctgcttagcttgctactcagtacgtgaattaggatgcaggcaacacacctcagaaggcaggaagaaaaaaggcacagctgataatcaagtcgttagagtcaaccatcattactaaagccaactctccacccagcgcatctaagcctgtgcctcttcttgccaccctagcatctcctaagccagatacagcaaatgaatgccggaagctcactatcagaatgttccaagacctttccataataaaaaataagtatttttttttaatgtgctatttttctacaaatatttactttcatgataa

SEQ ID NO: 374903 - DNA, 3597 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataatttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatctttttttaaaaacaaatattttccatgttatagggaaaggacaaagagacttttatcaagtttgcttttgtcttgtggctgtacatgctgttggcatagccctaatacagttgttcacaagtttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggtaaaaaaaaata

SEQ ID NO: 374904 - DNA, 2504 bp, Homo sapiens
gaagcaaacgcaaaaagtagtacacgtcgtacccgtgttaatcgtcacgaggagctagcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataatttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatctttttttaaaa

SEQ ID NO: 374905 - DNA, 1507 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagccattcaggatttcttacaatctccagctacaacctgcttagcttgctactcagtacgtgaattaggatgcaggcaacacacctcagaaggcaggaagaaaaaaggcacagctgataatcaagtcgttagagtcaaccatcattactaaagccaactctccacccagcgcatctaagcctgtgcctcttcttgccaccctagcatctcctaagccagatacagcaaatgaatgccggaagctcactatcagaatgttccaagacctttccataataaaaaataagtatttttttttaatgtgctatttttctacaaatatttactttcatgataa

SEQ ID NO: 374906 - DNA, 3571 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataatttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatctttttttaaaaacaaatattttccatgttatagggaaaggacaaagagacttttatcaagtttgcttttgtcttgtggctgtacatgctgttggcatagccctaatacagttgttcacaagtttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggtaaaaaaaaata

SEQ ID NO: 374907 - DNA, 280 bp, Homo sapiens
gactgcttatgtaaattgttttcttgcagttgttaacttgcttattgaatactaaaaattctgtctccactcaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactc

SEQ ID NO: 374908 - DNA, 464 bp, Homo sapiens
gcgcccgcgggggttgtaactaattaattaggtgaaatgcaagtatctgctaaccaaggggggtatactttcatgaaagccatctgccaactgagttagtgtgaactgcccaagaatgtgtaaggacttgggcatatttggccaatgtaacacatttttatggtgattgttttctaggtgtgctgggatatgcagctatgaagggaagggtggaatgtgttccatccgtctcagcgaaccccttttgaagttgaggccaagaaaggatcttgtagaggtatttttcgtgtaaacttgcttcctagcgcagtaatttacaaatacttgtcaatgatttagactgctgtgaattcgcctgtatgtatcgttaaaaaaagtcactttgccctcagtgaaagcttgaattatggggcaaacaataatgaacaccttatgttttttatagtgcttcatagtaaaaaaaa

SEQ ID NO: 374909 - DNA, 2829 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataatttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatctttttttaaaa

SEQ ID NO: 374910 - DNA, 3542 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacttaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataatttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatctttttttaaaatttgtcttgtggctgtacatgctgttggcatagccctaatacagttgttcacaagtttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggtaaaaaaaaata

SEQ ID NO: 374911 - DNA, 1468 bp, Homo sapiens
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagccattcaggatttcttacaatctccagctacaacctgcttagcttgctactcagtacgtgaattaggatgcaggcaacacacctcagaaggcaggaagaaaaaaggcacagctgataatcaagtcgttagagtcaaccatcattactaaagccaactctccacccagcgcatctaagcctgtgcctcttcttgccaccctagcatctcctaagccagatacagcaaatgaatgccggaagctcactatcagaatgttccaagacctttccataataaaaaataagtattttttttt

SEQ ID NO: 374912 - DNA, 2131 bp, Homo sapiens
  misc_feature (1485)..(1485): n is a, c, g, or t
tgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttccttnccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgta

SEQ ID NO: 374913 - DNA, 887 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaatagaagtgtgaatagtagaatattaattaaaatggaggctatcagcctgtgattttcagcttaa

SEQ ID NO: 374914 - DNA, 1806 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374915 - DNA, 629 bp, Homo sapiens
atttccttttttgtccaactctgtgctttttggatattaatggtcacacattgtttttagaaatcagagaaagaattgatgtcattacaaaacaaaaaacacatcctgaaatgatctttcagaaacaattaatcctcttaaatttgttcctcttttccgcaggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaatagaagtgtgaatagtagaatattaattaaaatggaggctatcagcctgtgattttcagcttaa

SEQ ID NO: 374916 - DNA, 1997 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggtgcggaagctgcaggtgccggtgaagaagctggggaagcagcacgaacagccgaggagccgctcgcgctgtgctgggccccggctccatcgcggttcgccggctcctccactccctcctacggcgcggggtcccctcggggcttccccttgggtctcagcgcaaagtcgggcggcggggccggatggacccgaggcggacgaataacgaggagctgcgagacgccaccttcttgctggcggcgggggagggcggcttgctagacgacctggagcgtctgtcaggctaggaggagggggaggagagctggtgagcgccgggcgccgggcggggctgggcggggacgccccggtggcggaggacgtcccggaggatccctctggtcgggcgcctggctttgtgtagccagccaggtccgctctcggcgggtactcgtggtcttgctctggcagaggggaggtcagttggagttgggggttcgaggcttgcaagtacagggcttgtagctccttctctggattgtggaccctctgggtgctgggccctattggggttggtgggttggttggatccagaagggctgttcgccgtggg

SEQ ID NO: 374917 - DNA, 2124 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374918 - DNA, 903 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgcgaggccgcccgtagcggaagccgcggcggacagaccctccgaaggcctggcggccagcgattgctgatctgtgcatggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374919 - DNA, 2068 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374920 - DNA, 1018 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaatagaagtgtgaatagtagaatattaattaaaatggaggctatcagcctgtgattttcagcttaaaaaaaaaaaaaaaaaaaaaaaaactcgagttttttttttttttttttttcatgattcattagacacttttaatgaaaatagtgcttgacaattagaaaacagttaaaatttttgttttagaaatagcattc

SEQ ID NO: 374921 - DNA, 2163 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaaaaaaagcagcaaaaagaattatggcctccttggcctca

SEQ ID NO: 374922 - DNA, 831 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaatgtacgttggtccttcttcgattagtggtccagggcacccggcggtccgacgtcgtcgttaactctggacgctgaaccgggccctttctgtggatcgccc

SEQ ID NO: 374923 - DNA, 757 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttccggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374924 - DNA, 2544 bp, Homo sapiens
  misc_feature (2316)..(2316): n is a, c, g, or t
  misc_feature (2318)..(2318): n is a, c, g, or t
  misc_feature (2320)..(2320): n is a, c, g, or t
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacaggtatagaagacagaactgaacttcaagcctgatggtgctctggcaacagaaagaggacacgagggagtaaagtccaaattcacagtccactgtcaatcccaagagggacaaatgagctggacaggaacagggaggaaagacagagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaacggggaaagataaaagcataaaattgggcatttgtgcgaaatgaatngngntggccaaagtcggccgtttccctttaggggggggtattaaataaccctcgttcattaacctcctgcccttgggcgtttgggtgcggcaaccgtttttatttaatttaaagggggaattaccgttttcccagaaattcgggatatacccacgaagaaaaatgtgtggcaaagggccccaaagggcgggaatccttaaaggggcggtgtttgggggttgtcctagg

SEQ ID NO: 374925 - DNA, 822 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374926 - DNA, 861 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaaaaaaagcagcaaaaagaattatggcctccttggcctca

SEQ ID NO: 374927 - DNA, 968 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgcgaggccgcccgtagcggaagccgcggcggacagaccctccgaaggcctggcggccagcgattgctgatctgtgcatggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaatagaagtgtgaatagtagaatattaattaaaatggaggctatcagcctgtgattttcagcttaa

SEQ ID NO: 374928 - DNA, 462 bp, Homo sapiens
  misc_feature (20)..(20): n is a, c, g, or t
  misc_feature (23)..(23): n is a, c, g, or t
  misc_feature (42)..(42): n is a, c, g, or t
  misc_feature (44)..(44): n is a, c, g, or t
gggagcgccgcccttggggnagngaggttcggtcttttcccngntggtctagttggaaaggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374929 - DNA, 760 bp, Homo sapiens
atttccttttttgtccaactctgtgctttttggatattaatggtcacacattgtttttagaaatcagagaaagaattgatgtcattacaaaacaaaaaacacatcctgaaatgatctttcagaaacaattaatcctcttaaatttgttcctcttttccgcaggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaaatagaagtgtgaatagtagaatattaattaaaatggaggctatcagcctgtgattttcagcttaaaaaaaaaaaaaaaaaaaaaaaaactcgagttttttttttttttttttttcatgattcattagacacttttaatgaaaatagtgcttgacaattagaaaacagttaaaatttttgttttagaaatagcattc

SEQ ID NO: 374930 - DNA, 2269 bp, Homo sapiens
gtcagcgtgttcaaatacttttaatacacaacttttaatacacaagacacactttggaaaactttttccgaagaaaatgatccaaagagcagaatgtgagtcaataaacggagaaaggcaagcagcggttttccatcttctgcgccagtgtgctgtaaacttttaagtccggaaaactatgttttaaccgatgagataatgcctttcaaagtgattagcacgaccgggcgcgcggtggctgacgccagtaatcccagcacttttgagtggctgaggtgagcggatcaccctgaggtcagggtcgagaccagcctggccaaaatggcgaaaccccgtctctactaaaatacaaaaatcagcgaggcgtggtggcgcccgcctgtaatcccagttactcgggaggctgaggcaggagaatcgctttaaaccgggaggcggaggttgcagagccaagatcgggccattgcactccagcctcggtgacaaaatataataataataaaattaaaaagggcttagcatagtatctggccagtaagaagaaattatgattattattttgaccttagacctctcttaactgtctgaaattcgggtttcttaaaggacacaggcggtctctgaggctcccgccagcggaaacaatctcccattaaaataggcatcggttaaatatttgctgaacaaagtaaactacgtctccccgaatcccattgagcgcctactcgagatccggaccggagccgggcaggacgggcccgtcggtcccacacgccgtataagtgggtggagaataccccacacgcccagaccaataggcggggtgaacgaggaccgtgttcaccaactcagcccggctcgcggaatgccttctgttcgcctccgggcttgcagtggctttccgtcgcaggtcaggccgcgttccacttccgccggcagtccagacacgcccctccgggtccaatccccgcccctcacacacctggccccgccccgtcgggagctcggcggtcctctctgcgctaggtcttcttagcgcccgacggggccacgcccatccccgacgctctgaggtcacctacagggccgaccctcggtgggcggagggacggagggaagatggctgcagagaccggatattggcgctgcctccccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacaggtatagaagacagaactgaacttcaagcctgatggtgctctggcaacagaaagaggacacgagggagtaaagtccaaattcacagtccactgtcaatcccaagagggacaaatgagctggacaggaacagggaggaaagacagagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374931 - DNA, 967 bp, Homo sapiens
agggcgccgagggcgggactggactcggcttgggcgtgagatggcggcggcagcggtgagcagcgccaagcggagcctgcggggagagctgaagcagcgtctgcgggcgatgagtgccgaggagcggctacgccagtcccgcgtactgagccagaaggtgattgcccacagtgagtatcaaaagtccaaaagaatttccatctttctgagcatgcaagatgaaattgagacagaagagatcatcaaggacattttccaacgaggcaaaatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacaggtatagaagacagaactgaacttcaagcctgatggtgctctggcaacagaaagaggacacgagggagtaaagtccaaattcacagtccactgtcaatcccaagagggacaaatgagctggacaggaacagggaggaaagacagagggggacttgatctcatcttcatgccaggccttgggtttgacaaacatggcaaccgactggggaggggcaagggctactatgatgcctatctgaagcgctgtttgcagcatcaggaagtgaagccctacaccctggcgttggctttcaaagaacagatttgcctccaggtcccagtgaatgaaaacgacatgaaggtagatgaagtcctttacgaagactcgtcaacagcttaaatctggattactacagccaaataatcagtgttttatatgagagtaaagcaaagtatgtgtatttttcccttgtcaaaaattagttgaaattgttcattaatgtgaatacagactgcattttaaaattgtaattatgaaataccttatataaaaccatctttaaaaaccaa

SEQ ID NO: 374932 - DNA, 603 bp, Homo sapiens
cgaccttatttgcctcgagccaagattccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374933 - DNA, 1516 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccagagcaataaagtcagctggctttctcaccaaaaaaaaaaaaaaaaaaaaaaaaaaaaaaaaaaaaaaaaaaaaaaaaaaaaaaaaaaaaaaaaaaaagggggggggcgaagataaaagatgcgcacccgagggggacacaaaaacaccacaccccaccgggcgatgctacacagaggggtcacaaacaaagagaggcgaaagtaccacaacaacacgaagcacgcgcccacagaacaaaccacaacactaggcacgaggacacaaaccgagtccacccggggcgacacacgcgggggggggagaacacacaacaaaggaggagggaggggagcgaaatgaagggcgcggaacaacaacacgagcagccgagaaggaagagggggacgccgcagagggcggaaaaacaaacaacatagaccagccgggaggacaagggagaagggaaacagcagcgcgagcaggcatcacccacggcgcgcgccgaagaaagagaatgaaagagaacagagaagaagaagacaagagcgagcaggcgagacaaagagaccacctacacagagcggtgcgcggagctgtgctacacagcaacagaccgacacccagggacagcgagggagacagagagcgggaggaagcgcagccgacggcagagaggaccaggaaggaagtcagaggagccgaggtaagagaggagcgggacaaggggcggggagggagcggacccagagcgaaagcgggacgagccaagcaagagaggagtaggaggagcgagagcgaggtgaggagggcagaagagcgagcaagagaagcaaagaacagagagacggaggagaagacgaagagacaagggaacgacacaggaagagagcgacgcgagct

SEQ ID NO: 374934 - DNA, 963 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaagcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagaagtttgtgcggtcgacactgaaactggttacgcgacaatctgcgtggactctcatgttccgtaggttggagtcccatagctttcgccctactcgttcaactcacccaagatcatatcttaccttatgaattcaacctgcactgtcgagcgccttattatacttatagtagattttctcgcttccttgaagccgtccttacctacctctaacccaattccaaaggtccgctcatgatataataataaacttcaattgtatatccacccccacttttctattatactactgtgttaggcaccataccctcttccaatctttcctatttaccgactctgtatccatacacgaacacacattttactcccgtatatatattttcataaccgttaaccgctcacagaaactctctctacttcgctgccgccttcccataacaatgcgcactcactctgcacttaactactgacgact

SEQ ID NO: 374935 - DNA, 594 bp, Homo sapiens
gcggccgcctactactactactacattcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374936 - DNA, 604 bp, Homo sapiens
ggctgatgctgaggtgactctaaggattcccgtacttggagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374937 - DNA, 1283 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaaaaaaaaacttcaggggggggcccggggcccattacggcctatatggaggcggattacaattcacttggccgggggtttacaacgcggggactgggacccggggttacccactaattagctttgagtcccctttttcagctggggatatcgggggcccacgtcgcccttcc

SEQ ID NO: 374938 - DNA, 1617 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaaagatgatgaggagcaggatgaagtacaggcgcagcaggttccgacgctccttgaaggtggcgcagcagcccaagaccccagtcaccatgacgacagtgcccgccaccaccaggatgtaggctgtggccaggtaggtgcctgaggccagcaggctgatgtagtcactcttgagggccagcgtccagatgcccactgccatgacagccaggccagccagccagaaccacaaatatcg

SEQ ID NO: 374939 - DNA, 1294 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgtctccgaggaaccctttggactgtcagggctggccggctctgctttgatgtagag

SEQ ID NO: 374940 - DNA, 1260 bp, Homo sapiens
  misc_feature (1119)..(1119): n is a, c, g, or t
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaacaacgnaataaacaaacatgccggcgcaattcgagcttacattgcccaattccccctatgtgagccgtatacaattcactgaccgtcgtttaacactgtcggacttggaaaccctgccgtaaccaacttaaatcgcttggacacaac

SEQ ID NO: 374941 - DNA, 2145 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374942 - DNA, 2151 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374943 - DNA, 1972 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374944 - DNA, 1392 bp, Homo sapiens
gtttttttgccgtgctggtgtgcacagtgcaatgtgatatgcggaatgatatagagagaaagtgaatagatgtcatgggtcgggttagaagatgtgtgttaagtttgtgtctgctgcccgttgttggtcgatacgttgtgttccccgcgttgttgtgcactctggtcgtgtgtgtcaaatgtttggttggacggagaaatcataagcagtaaaccggcgttttggctattttttcccccccccttttggggcccccccatttccccccctggcccaaaaaaggggcccggaaacacctgccccgcccctttctacccctttttcccccccccccaaaaaaccccgcgcgttttttttttttttttttttttttttttttttttttttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374945 - DNA, 2234 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374946 - DNA, 1044 bp, Homo sapiens
actatagggcaaaagtgtgttttgttgttttgtgtttttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374947 - DNA, 1196 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374948 - DNA, 1279 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374949 - DNA, 2070 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgaagataaaagatgcgcacccgagggggacacaaaaacaccacaccccaccgggcgatgctacacagaggggtcacaaacaaagagaggcgaaagtaccacaacaacacgaagcacgcgcccacagaacaaaccacaacactaggcacgaggacacaaaccgagtccacccggggcgacacacgcgggggggggagaacacacaacaaaggaggagggaggggagcgaaatgaagggcgcggaacaacaacacgagcagccgagaaggaagagggggacgccgcagagggcggaaaaacaaacaacatagaccagccgggaggacaagggagaagggaaacagcagcgcgagcaggcatcacccacggcgcgcgccgaagaaagagaatgaaagagaacagagaagaagaagacaagagcgagcaggcgagacaaagagaccacctacacagagcggtgcgcggagctgtgctacacagcaacagaccgacacccagggacagcgagggagacagagagcgggaggaagcgcagccgacggcagagaggaccaggaaggaagtcagaggagccgaggtaagagaggagcgggacaaggggcggggagggagcggacccagagcgaaagcgggacgagccaagcaagagaggagtaggaggagcgagagcgaggtgaggagggcagaagagcgagcaagagaagcaaagaacagagagacggaggagaagacgaagagacaagggaacgacacaggaagagagcgacgcgagct

SEQ ID NO: 374950 - DNA, 972 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374951 - DNA, 1264 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaacgaagaggacctgacgcactccctctaaatgaagcctagcatgctcaataccacggcgctccggcgcgagccgaagcccaccttaagagcaattccattcagtggatatgaagcacacttcggactacagtagcgtttcgaatcgatgggcaacacgcttactccacgcattatggcaaggctcaattcccacactccgctcagccaccgttcaccgcaagtcgcaacacccacaaccttcgacgctctcgacagcccatacatcgtcactattcatagcagacatctatccccagggcagcgtgccacttgacaacaacccctcggcactcagcacacacgcgcacttcccgacactccatcctcaaagctcgtcaaccgcgtgcagctatcactgaccttcaccccgctcgcctccagccacgtccgaggcgcgacgtctccatgcagctctcttaactcgccctctccgatc

SEQ ID NO: 374952 - DNA, 814 bp, Homo sapiens
actatagggcaaaagtgtgttttgttgttttgtgtttttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccccaggggtccaggggctggagtctgcttggagttattgcttcaaggggggacactaatgcccaatgcaaatgatgagaggaggagcgaagggggcatgggcctttgctctcaaagtcccactctgctttgaagagggggtaggattaagcagcagcaaaa

SEQ ID NO: 374953 - DNA, 690 bp, Homo sapiens
gaatacgcagtgggccggggatgaatcggacgagggagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374954 - DNA, 1107 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374955 - DNA, 2062 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374956 - DNA, 1975 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccccaggggtccaggggctggagtctgcttggagttattgcttcaaggggggacactaatgcccaatgcaaatgatgagaggaggagcgaagggggcatgggcctttgctctcaaagtcccactctgctttgaagagggggtaggattaagcagcagcaaaa

SEQ ID NO: 374957 - DNA, 1190 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggtacccgccggcggcagtcttcccttttcgggcgggatggtgggccggggtccagtgcttgcctaaactcctccgccctgcaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374958 - DNA, 1981 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgaagataaaagatgcgcacccgagggggacacaaaaacaccacaccccaccgggcgatgctacacagaggggtcacaaacaaagagaggcgaaagtaccacaacaacacgaagcacgcgcccacagaacaaaccacaacactaggcacgaggacacaaaccgagtccacccggggcgacacacgcgggggggggagaacacacaacaaaggaggagggaggggagcgaaatgaagggcgcggaacaacaacacgagcagccgagaaggaagagggggacgccgcagagggcggaaaaacaaacaacatagaccagccgggaggacaagggagaagggaaacagcagcgcgagcaggcatcacccacggcgcgcgccgaagaaagagaatgaaagagaacagagaagaagaagacaagagcgagcaggcgagacaaagagaccacctacacagagcggtgcgcggagctgtgctacacagcaacagaccgacacccagggacagcgagggagacagagagcgggaggaagcgcagccgacggcagagaggaccaggaaggaagtcagaggagccgaggtaagagaggagcgggacaaggggcggggagggagcggacccagagcgaaagcgggacgagccaagcaagagaggagtaggaggagcgagagcgaggtgaggagggcagaagagcgagcaagagaagcaaagaacagagagacggaggagaagacgaagagacaagggaacgacacaggaagagagcgacgcgagct

SEQ ID NO: 374959 - DNA, 1251 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaaaaaaaaaaaaaaaaaaaaaaaaattccggggcttcttttggggggggggaaaaaggggtttggaatgggccttgggcatgtgttttctggccccggttttttggtccaagggggggattcggggggtccccaaaggggggcgga

SEQ ID NO: 374960 - DNA, 1810 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccagtcccaccccttgcctcagtccatcatggcctcgagcatctccaagaacagcttgtgcatgggcaccttgccctccagcttcaccccatagaaatgggccagcactttgcccgctgtctggcggaggagcggtagcgtgagcagcagcctgcccgcccgccgccgctcagcaccccctccggggccagcccggccggcttcatactccagcagggcctcgtgcagagcttctcgcagctgctccac

SEQ ID NO: 374961 - DNA, 1848 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagccaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggactctggcctccatccccttccctccctgagataggtttctgcctcccacgcatcccgtgcagccccctatggcttccgcaaggccccctacactctgggggcacgttatggcttgcaaggggcagcactgtgcccagagcctggacacacgttcccagcttctgacaccccctaggagggggaggagagggcgtggggcctgttcccaggggctgatggcattgccctggccctgccagcaggctgtggcactgcccagaccccagctccgccccagcccttggggctgaccccatgctaggcaggtcctgccagaacccccaccccaggggtccaggggctggagtctgcttggagttattgcttcaaggggggacactaatgcccaatgcaaatgatgagaggaggagcgaagggggcatgggcctttgctctcaaagtcccactctgctttgaagagggggtaggattaagcagcagcaaaa

SEQ ID NO: 374962 - DNA, 1106 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgccttcccatctggaggtcccaccaggctattaaaggggaatgttactgcaaa

SEQ ID NO: 374963 - DNA, 1223 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacgtgaggatccttaccccgccccagcatatcccggggaatgcggggcgggcacacctcagccgggctgaggcgggagttcgggatgcccggagataattttggcctcttgcccacagttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaa

SEQ ID NO: 374964 - DNA, 1236 bp, Homo sapiens
gggccacccgcagaacagagcttccgggacccacgcctcgtttgcactgggtgctggacagccgacgcaactacaaatggggcggagctttcggcactggagcagctaatttgcatataggaatgaggtgcggctcggcttccatgggcctaatttacagatagggcggtatttctgccccttaaccgaaagtgggatacagaggacgacggtgttaggcgcctgtgtaggagtaaaatgtgtttattttgcattcaacgagagctcctgcattgcagctattttgcatatgatttgcatcttacgaagaatttgtggcaaaaaaaagctgggcgtgcgccgtaggaacctcctgctgagacgcttccggtagcggcgcgtgacccgacaggtctttcacctacctacctcagctcccacaaacacgagaagttccagcaagttcgccacttccggttctcctggctatccaatagcatcgagtggagcatccccggaagtgaggcagcggaggacgacctttttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgatacctaaagtggagtggtcggcgttcctggaggcggccgataacttgcgtctgatccaggtgccgaaagggccggttgagggatatgaggagaatgaggagtttctgaggaccatgcaccacctgctgctggaggtggaagtgatagagggcaccctgcagtgcccggaatctggacgtatgttccccatcagccgcgggatccccaacatgctgctgagtgaagaggtcactgagagattgttgcgccagcgccaggttttctaggtatgatcgcgcttttagaagatctatccccggataccgaatgctggcgcgtaaccaactgttgacccaatgtcctcttccacagagctgcagagctcggtatgacctgtactgttcgtcattacgggcaggtgcctcacctttaggatcacaggaacgctgaacccgtcagatattgcgacacctttccacatattctcttatggctataacttgtttaaccaatacgccccaagatggagtaacctctgtaataatgagcccttattccgagc

SEQ ID NO: 374965 - DNA, 385 bp, Homo sapiens
aaataataatgacttttttgggttctactgacccggcctggattcagactgctgacccagaaaagaaaggcttcacacatcccattagcagtcctttcagccattgaagacatccccatccaattctgactttctttcctttacagcagtcttgctcttttttacgggcatgtaaaccaaattgacgtttacttactgcttttgtttggttccttgatgtaacttctctaatttaacagcagctttccaggcatagcgtttgaatgaatcaggccaaataacattaaagttcactttctcaaagcttaaactctgttaccgagaaaagatgggggtagagttttaaagtattcttcttagtataaaactaaacgtttttctctag

SEQ ID NO: 374966 - DNA, 425 bp, Homo sapiens
tttttttttttactctacctaacaatcacgtctgaaaccctattgtcactcgttgggtcctcctagatatcatggcctggtagacaccaagagaacgcttttaaatatttcagaatcagcacagtagatctctgttctacaattttaaatagcccctgcacttttttacaacacatataataaactgacaagttggtaactagagtccattaataaaataggaatggtcacgttgaaaagtttggaagccaggcaaagcagagaatggctgaaaataaatgcttagcatgaaaagagataaagggaggggtgagggaagagtaagcaacaggcaatgaaagagacatgagagagaaagagaaagagagggaggaattggaggtgaggagttgggaaacgttatctatctttaaatattagatggg

SEQ ID NO: 374967 - DNA, 501 bp, Homo sapiens
ggtacaatatgtgtatatagttctatatcattatatcacataggtagattcctgtaaccaccaccaccagtcaagatacaaaactcttccaccaccaccattaagaacacccttaatagtcactgccccacaaccatccctatcccatcccttacacccactaactaatgttagtattttacttggtttataccttgctccaggctggacctgatttttggagactaaatacttaaattaatttgcctgtcattggtatcccagttatccagacagtcgtattataatatcatggagttagactttacaaaaataactgattcatgctccttttctataaaaaacagcaagtgatcttacctacctacgcagaaaaaaatataaagttttaacagtgcctgccttacaataaagcgtagtggtaagcgatgtccaaaaaaagacgataacattttgatatcaaaagtctaataaaatacaggttattttaacaccatcccc

SEQ ID NO: 374968 - DNA, 474 bp, Homo sapiens
gctcctctctgcagatggtagtcccaacatctctgaaggtctctgaagctctcggcagagcaggtagcttgtctctgctactgaccatcttttgcttagctgtggctgatcctggggcttttatgagcctcagaggagaggaagtgtgtgactattcattcatgagtgactaagaatgggcccggaaaaggcaccacatattcccactccagtctataggactggcagcctggcccccaggcttcatgccctccttgagcctgatgcccaggctcagccccaactttgctccaagattggagcaggtgccaagagcagggagaagccaggcaatatgagcaggaacttctgagcctgaaagggcaggaagtccttcccaggcccctaagagtgtagggatgtctcagtctgcagctgcaatttgggtggctacagctgtgcctgggagggcatggcttctgcccactcccagcc

SEQ ID NO: 374969 - DNA, 1305 bp, Homo sapiens
atgagggaaatcgtgctcacgcagaccgggcagtgcgggaaccagatcggggccaagttctgggaggtgatctctgatgaacatgccatcgactccgctggcacctaccacggggacagccacctgcagctggagcgcatcaacgtgcaccaccacgaggccagcggtggcaggtacgtgccccgcgctgtgctcgtggatctggagccgggcaccatggactctgtgcgctcggggcccttcgcggaggtcttcaggccagacaacttcatttcccgtcagtgtggggccggaaacaactgggccaagggacgctacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagcgctatatgacatatgttccaggaccctaaaactgcccacacccacctatggtgacctgaaccacctggtgtctgctaccgtgagtggggtcaccacgtgcctgcgcttcccaggccagctgaatgctgacctgcggaagctggccgtgaacatggtcccgtttccccggctgcatttcttcatgcccggctttgccccactgaccagccagggcagccagcagtaccgggccttgactgtggctgagctcacccagcagatgtttgatgctaagaacatgatggctgcccgtgacccccgtcacggctgctacctaacggcggctgccattttcaggggtcgcatgcccatgagggaggtggatgaacagatgttcaacattcaagataagaacagcagctactttgctgactggctccccaacaacataaaaacagccgtctgtgacatcccaccctgggggctaaaaatgtcagtcaccttcactgggaacaacacagccgtccaggaactcaagcgggtctcagagcagtttacagcaacgttcaggcgcaaggccttcctccactggtacacgggcgagggcatggatgagatggaattcactgaggccgagagcaacatgaacgacttggtgtctgaatatcagcaatatcaggatgccacggccgagggagaaggagtatga

SEQ ID NO: 374970 - DNA, 689 bp, Homo sapiens
gggaaatgtaggggagcagccggactgagctgcccaagggggtcggcgccccaggcttcttggtggcatgctggggagcggggagggggcgattcttacccgaaggctgccgagctacaggcggcggtcggtccgggcgtctgctgtaatccactaggcgctgcccggctgcgctcactctcggacgcagagacccgctcatgttggtgaagaagccgcgccagaaccgcgcggctgcagtcacctcgagcaggccggctgctcctggcaggcggtgtcggcgccggcgggggactcggcgcccagggccccttccaggccctccctcgccgggctccccaccagctccggaggtggcggcgatgcggaccgagtgagcggcggtggggccaggccgggcgccgggcgggagccgaggccgcggcggactccgcaatcccgcagccggtgactggagcccacctctgcagagacaaaggaactgctctggtgaactccccctgaaagtaaatgtccttggctggcctccagcattcccctcatgggcatagccatgcagccttcagaaccttcctgaaagagatgcccaaggattcagcaaacacgggggaagcagaggacacaagaagcttggatgtgaaatagcacttccttctgtgttacagaataaaacaatattttaaattaca

SEQ ID NO: 374971 - DNA, 667 bp, Homo sapiens
gggaaatgtaggggagcagccggactgagctgcccaagggggtcggcgccccaggcttcttggtggcatgctggggagcggggagggggcgattcttacccgaaggctgccgagctacaggcggcggtcggtccgggcgtctgctgtaatccactaggcgctgcccggctgcgctcactctcggacgcagagacccgctcatgttggtgaagaagccgcgccagaaccgcgcggctgcagtcacctcgagcaggccggctgctcctggcaggcggtgtcggcgccggcgggggactcggcgcccagggccccttccaggccctccctcgccgggctccccaccagctccggaggtggcggcgatgcggaccgagtgagcggcggtggggccaggccgggcgccgggcgggagccgaggccgcggcggactccgcaatcccgcagccggtgactggagcccacctctgcagagacaaaggaactgctctggtgaactccccctgaaagtaaatgtccttggctggcctccagcattcccctcatgggcatagccatgcagccttcagaaccttcctgaaagagccctcggtcccgcagtcgggccccgtcgctgactctccagcttccgagccgcgggcggcgagtccagggcacacggagcggccgc

SEQ ID NO: 374972 - DNA, 927 bp, Homo sapiens
gggaaatgtaggggagcagccggactgagctgcccaagggggtcggcgccccaggcttcttggtggcatgctggggagcggggagggggcgattcttacccgaaggctgccgagctacaggcggcggtcggtccgggcgtctgctgtaatccactaggcgctgcccggctgcgctcactctcggacgcagagacccgctcatgttggtgaagaagccgcgccagaaccgcgcggctgcagtcacctcgagcaggccggctgctcctggcaggcggtgtcggcgccggcgggggactcggcgcccagggccccttccaggccctccctcgccgggctccccaccagctccggaggtggcggcgatgcggaccgagtgagcggcggtggggccaggccgggcgccgggcgggagccgaggccgcggcggactccgcaatcccgcagccggtgactggagcccacctctgcagagacaaaggaactgctctggtgaactccccctgaaagtaaatgtccttggctggcctccagcattcccctcatgggcatagccatgcagccttcagaaccttcctgaaagagatgcccaaggattcagcaaacacgggggaagcagaggacacaagaagcttggatgtgaaatagcacttccttctgtgttacagaataaaacaatattttaaattacacaagcagatggggcaagtttttgggccctcagaagcccagaagacttcacactagtatactggtatatacatgtggaattgagcaaataacttgtttaattccaaaattttctgagaaataatctcaatagtcaatttgcctcattatcctctccccatcttacccaaataaaagcagagctttatgaccctccctttcaacttggggaatgagggccgcaaagacactttgcactga

SEQ ID NO: 374973 - DNA, 296 bp, Homo sapiens
gccatttgttatcccttgaaaaagttctgatgaccttggatgtttttgattaaaggacttttgctgccatctgtcagcaaaagtcatattctttctagaaaaaagccaatgggccctaactttgctggagggaaccgcagcagcagccagggcccattaaaatgttctctctcctcccatgtccatccctagatgcccaaggattcagcaaacacgggggaagcagaggacacaagaagcttggatgtgaaatagcacttccttctgtgttacagaataaaacaatattttaaatt

SEQ ID NO: 374974 - DNA, 3907 bp, Homo sapiens
agcgcggaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcaggttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgca

SEQ ID NO: 374975 - DNA, 4391 bp, Homo sapiens
agcgcggaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcaggttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgcaaaaaaaaaaaaaaaaaaaaaagaagtgatagggtttgtgtgttatattttcttttaaagccatcatgtgaaatgtcaggactgagaaaagtgatttttttgctttgtttacaggaatcatgcttaaagagataatgcccaacatgtttattttatagtttttgttaatgataaccttttgagcattagtttggaatttggacatgatatttatttattcctttcttgaggttatagcagcattaatttcaaccagttatgaatactaaaaatattgcactctatgtaatagtagtatatttattactaaatcaatgtatatattaatagcacaggcaaaaaatggcaaatattaaaatattttcaaaatattatattatcctgttcacattttgtccacagtggttattgggaataatattttacactttttgctggcccaaatggctacataatattgagttaatgaaagttttctactccca

SEQ ID NO: 374976 - DNA, 2339 bp, Homo sapiens
agcgcggaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttaacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaatactt

SEQ ID NO: 374977 - DNA, 314 bp, Homo sapiens
ccaagaggctaaagatttgatccaaggtaagaatctaatgaaattttacattttatatgatgtgtagtgattgaagtagaatcatggccattacacatacattcatatgttaattactcgaggaatccatgtgtattctaaaaggcttccaggctactctcttcagccttgttttcttatcagaacattctctttagtaatggtatccacatttctaacatgagctagcacttgacttccactggcatctcagtcaagcacatctaaaacaaaccaatactttttgactgtccttccccccaaacacgctcctc

SEQ ID NO: 374978 - DNA, 318 bp, Homo sapiens
attgctatctgaatctagaactctatctacatgatactgtatgctaaattgtatatagcaatatattaaaatcagtgccttatggtgaatccaaagtgattaaaaggaaacactgcttttcatttatgaatgcatgtttaagaaagaaaaatgtatttcatttttagattatataaatggtggtgaactttttactcatctttctcaaagagagcgtttcacagagcatgaggtgcagatttatgttggagagattgtgcttgccctcgaacatctccacaaggtaagactcttcatttttcaggtttcttttctgaa

SEQ ID NO: 374979 - DNA, 542 bp, Homo sapiens
actcagaatgcgtcaagtctgcttgcattgggactttgtgttcagaattttaaatcttagacacagaaccagtaaaagcaatggggatagtttagattactgatggtcttcaggaatttccagtcaattgtttcgtattaggatgtagtactaacttcttcaaaagatttattagaattgtgactctcagaccgcctagctagtttgatataaacagagccctcagaatttttttcccatgaacttctccaccctgccaatagacttagatataaaggttttaagagctttgttcccttaaaacaacttggggctgcagttgccaatggaaagttgtcttctgctgtaagtcataactgctaggaaagcttcagtacttttaccttcacaggggttccctttttttcccccgccaggcctttaacaaatacaagagagaggggttttgccttcagaatgttgataaggcccctttggctaagagaagaaaaatgaaaaagactagcaccagtaccgagacgcgcagcaggttccagtgagag

SEQ ID NO: 374980 - DNA, 3230 bp, Homo sapiens
agcgcggaggaggcggcggtggagcagggggcggtttggttgcgcggtactagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcaggttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtg

SEQ ID NO: 374981 - DNA, 239 bp, Homo sapiens
gtaaactaagtcagtctcaaatgacacacatacaaatattgaaattatagtttggagagtaagtcagtgattgccaggagctaagggggtggagggaatgactaaagagatagcaaaaaggacggttttagggtgatggaactcttttgaatcctgattttggtagtagttacttcaatctgtacatgtgttaaaatccataggactgtatataacaaaaataaagtcaattttattgt

SEQ ID NO: 374982 - DNA, 378 bp, Homo sapiens
gaaatgacaccaaatgacaactcagatacaagaagaaactaaaagcaacagaaatggcaaatatgaaataacatgtgtacatacttttctcttaatatctttaaaagatggctgcttatagcagaactaataacaccgtatttgatgggtttgtaaagtgtgcagatgtaatatatgacaacaatggcactcaggactgggatcgtacatggatatatgctgttgcaaggtttcagtgttttctctgaactattatctaaatattaactctgaataaattgggtaagttcaagatgcatattgtaatctctacagcaaccactaaaaaatagttcaaacagatatagctaaaagcaatagaggaattaaaatgacatt

SEQ ID NO: 374983 - DNA, 1113 bp, Homo sapiens
  misc_feature (210)..(210): n is a, c, g, or t
  misc_feature (804)..(804): n is a, c, g, or t
atggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgnctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgngcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtga

SEQ ID NO: 374984 - DNA, 350 bp, Homo sapiens
  misc_feature (145)..(145): n is a, c, g, or t
ccccaatcaactcattcatcttttcgcattcatccgctcttgcacatctcagcctgaggcttggaaaagaactttttctaggctgggtgtctcagaggcaacagggaacatgaacaaaaaggtggcaaaagcataattcaatgtncgtgctggttttaaggtcatgcacacattggagcacgttctatgtgccaggtgccatccctcctgggtccaaaaatgactgaatacaaggctaatacatagaaatgggtagtgacaaaatctaatcctttgatcaccagagagtccatcaccagaacacagcaataaaatcttgcatgtgtagagtgccttagagttgccaaagc

SEQ ID NO: 374985 - DNA, 1648 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatca

SEQ ID NO: 374986 - DNA, 2166 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatcacaagagcctgctgattggggctcagggacaccagccaggacagaccggcccccgagggggcagccagacaggtgggaggggcctcccacgaagctcagaagaaaggtcgtgcgggagccgatggaggtggtcgcctggcacaagagaaaaatcagaaagcaaagtttaactgagccccagttgggccacgaggcttgggcttccccacgaggtgagagaagcagggcctgagggtaggaagggggtggagcgctggggtccccgcttcaccaggcagcagccaggcctgtgcacgtgggggtgtgcagggggtcagagaatatctgctcccactcctcacatgctaaggaaagtaaaagctctcccctgtatcgagtggcttcctctgaaaggtgacacccccgaaagcagagccctcagggagatgggaggcacttatgagtgcagggacttgggcatccttatgggaggcctgatggaggtggcacccatgtccccagcctgaacactaacacaag

SEQ ID NO: 374987 - DNA, 1559 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtaccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatca

SEQ ID NO: 374988 - DNA, 1919 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatcaaaaaaaaaaaaaaaaaaaaaaaaaaaaaaaaaaaaacaaaaaaaaaacaaaaaaaaaaaaaaaaaagaggggggggcgcgcccaaaaaaaatatcccccgcggggggccccaattgggcccgcccccgctttttttttaaaaagggggccccccaaaagggggcggttttaataaacgcagagccgcgggggcgccgcgtatcataaccacacgcccgccgggcggaggagaaaacaacgcggcagcagcgggacctccctggtgggaggaagaacccccaccacggggggcgagggacaaaacaatgtgcgggacatcaccccctcccatgagaaatagaaagcccccgcggggcggaccaaataaacccggcgagggcgacagcgtgcggtgtcaaccaccagcgcggatattaccagcgggctgcaaaaaaatgtgccccagggaagtggtctgagcaccaatttattcgcggc

SEQ ID NO: 374989 - DNA, 1272 bp, Homo sapiens
  misc_feature (21)..(21): n is a, c, g, or t
  misc_feature (26)..(26): n is a, c, g, or t
atagggctaggtacgaggctngtggngccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatca

SEQ ID NO: 374990 - DNA, 2125 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatcaaaaaaaaaaaaaaaaaaaaaaaaaaaaaaaaaaaaacaaaaaaaaaacaaaaaaaaaaaaaaaaaagaggggggggcgcgcccaaaaaaaatatcccccgcggggggccccaattgggcccgcccccgctttttttttaaaaagggggccccccaaaagggggcggttttaataaacgcagagccgcgggggcgccgcgtatcataaccacacgcccgccgggcggaggagaaaacaacgcggcagcagcgggacctccctggtgggaggaagaacccccaccacggggggcgagggacaaaacaatgtgcgggacatcaccccctcccatgagaaatagaaagcccccgcggggcggaccaaataaacccggcgagggcgacagcgtgcggtgtcaaccaccagcgcggatattaccagcgggctgcaaaaaaatgtgccccagggaagtggtctgagcaccaatttattcgcggc

SEQ ID NO: 374991 - DNA, 1763 bp, Homo sapiens
actccaccacgtcggtcccgccaaaggttgtcacgcgcggcgcactctgggaaaaccacgtggaggtgactaaaaaggaccctgccgcctgtaactttagttgtcttagctactgcctacaaaagatgcgccatcatggcacttatttttgtaattttcctccaccagcggccgagaagagagccgaagcctttgagaaaaatattcccagacggttgagtgtttctgggcacatcaggcattcattcgggccgcctgccctctagtgggggggtccttcactcctggcacctctggttacggacaacatacagaagccactgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggtgtgtccaggctgcgctggggccactccttccagatctctaggattcacctggggtgccccccttgggctgacccagcctcccctccgtagttgtgccctccaactgaattatagagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggagtcaataaattatggtcagaaaatca

SEQ ID NO: 374992 - DNA, 338 bp, Homo sapiens
atacttatcactgcaaaaccaccagttttcagttcagttgggggactagacatgaggctcactgggcaaattaaagtaacatttcttggaagttgggatgaccttggatactcttaattaaacttttagaatgttttttcatttttctgagagcaccaacatttcactaattttcatttataaaagcttttagagttaatatagtggtagctgtttctggcaagtgttaagactaaaacttcgggtattttgtaattgtaaagaatcaagacctaatatgatttgatgttgactaggagagaaaattaacaggtagaggcctaagactttgttcatgg

SEQ ID NO: 374993 - DNA, 392 bp, Homo sapiens
gtttcccagactcctttgcttctgacttctgggagaatccagccaacgtgaggcattggtgggacacaggaatgtgggggagaaggaggaggaggccagagcatttctctctctctctagccctcccgcagtacatagctcctgcagagtagtccctctgggcccatctcttgcgaggtccacctcctcctccctttgtcctcctggtgagtgtttggctcctgtagtagtccattttcacatcgctataaagaactacctggtgcctgtaattccagcttgggagaatgaggcaggaaaatcgcttgaacctgggaggtggaggttgcattgagccaagattgcgccattgcactccagcctgagtgacagaatgagactccatcatttcc

SEQ ID NO: 374994 - DNA, 2153 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 374995 - DNA, 910 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcgaaccatatccaaatggcctttgtagcaagcaagtgttagagcactttctttggattc

SEQ ID NO: 374996 - DNA, 772 bp, Homo sapiens
gcacgagtaagagtctagatctagagaaaatacaaacattccatttctcaagttctttgaaggttcttgttttagttgaaaagtggaagccttaagtacatttataatgaggggaaaagctatgtaactatttatcttacagtattttcctccgtcctcccaacttctgatatgcccaaatctcttgatttcattattttctttggttagatatttttaaatgttgctctgtttttgtggctttgttttttgagacaaaggcatgaatttaaataattctgcagaaatatttctacatatattaagatttatattgaagttttattggtaaaaaaccataatatcacccccttaaaaaaatttatactctgctcatgacattacagtctctacagatgagaatctttttagttgaagatcctgagttaacaaagcccaccatctgaagtatcggtcacaaggtcttcatggccaaatgtgattttcgtttttggaataagatccgtgagttcttctttttcctttcgcaggacgacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 374997 - DNA, 1167 bp, Homo sapiens
ataacgcttcccctataaacccgttcgtctgcaattcaaagtttttccctggcccgcccccctcttctataccaaaaaggctttccttgttttcaaagcccattgaaaggtgccttttcctgaggggtcgtccaaggcccaaacgatgagatgcccctccttaatggaggccgtatgatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgtt

SEQ ID NO: 374998 - DNA, 984 bp, Homo sapiens
gcacgagtaagagtctagatctagagaaaatacaaacattccatttctcaagttctttgaaggttcttgttttagttgaaaagtggaagccttaagtacatttataatgaggggaaaagctatgtaactatttatcttacagtattttcctccgtcctcccaacttctgatatgcccaaatctcttgatttcattattttctttggttagatatttttaaatgttgctctgtttttgtggctttgttttttgagacaaaggcatgaatttaaataattctgcagaaatatttctacatatattaagatttatattgaagttttattggtaaaaaaccataatatcacccccttaaaaaaatttatactctgctcatgacattacagtctctacagatgagaatctttttagttgaagatcctgagttaacaaagcccaccatctgaagtatcggtcacaaggtcttcatggccaaatgtgattttcgtttttggaataagatccgtgagttcttctttttcctttcgcaggacgacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgtt

SEQ ID NO: 374999 - DNA, 1100 bp, Homo sapiens
ctattgttaatcatccttctagtacattcctacaaattctattctttttgtgttttctgttttggtttttcaaaatttcaaattaggtggcaggttcatatgtgtaataatctatataaaaataatattccatttaaatgttcatgcctcttgctgaaatgtgtgctttgcctagcttttattttgtgagagtgctttaaactgcttcctagagtttttcccagaattctctgatacatttcttaaaaacttatgtgtgacatacatagctgtaaatgttatagagaattagatttcttagttttgcttatttagaaaaaactatgcaagtattaccttttaaatcatccaagtagatacctgagaacattattggaaaataattattaaccaaaataaatgtgtagtatgattgttatttattatcatttctactaatacaaaatattgtaatgaaaacactatcattcattcttattaattaggaccttccctatcagttataatttttgggaggtatgcttttttgtctgagaattgtgacagcaatatatgttaagtacatcttagtcttttgacttctttctatatctttttccttttatagagttgctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttcttctaaaaaattgaatagggctgggtgcagtggctcatgcctgtaatcccagcactttgggatgccgaggtgggtggatcacctgaggtcaggtgttaaagaccagccggactaacttggtgaaaccctgtctctaccaaatacaaaaagttagctgggtgtggtggcacatgcctgtaatcccagctacttgggaggctgaggcagaagaatcagttgaacccaggaggtggaggttgcagtgagcctagattgcgccattgcactccagcctgggcaacaagagcaaaaacgccatctcaaa

SEQ ID NO: 375000 - DNA, 483 bp, Homo sapiens
tgctcgaattcaagcttctaacgatgtacggggacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgtt

SEQ ID NO: 375001 - DNA, 2365 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgtt

SEQ ID NO: 375002 - DNA, 2189 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagaacatgaatctgaaggtggaagaacacctttgatgaaagctgcaagagctggtcatttgtgcactgtgcagtttcttattagcaaaggtgccaatgttaacagggctacagccaataatgatcatacagtagtgtcgctggcatgtgcaggaggccacctggcagttgttgagcttctcttggctcatggggctgaccctactcatcgactcaaggatggttcaacaatgctcattgaagctgcaaagggtggccatactaatgtagtttctta

SEQ ID NO: 375003 - DNA, 1445 bp, Homo sapiens
gagcgatctagaggatcccctgatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 375004 - DNA, 300 bp, Homo sapiens
cggcagcggtacgggcggaggggacgcggcgctggatttcaagttggcggctgccgtgctgaggaccgggggtggaggtggtgcctctggcagtgacgaggacgaagtgtccgaggtaaggctccgggaccctcgcctcccacacattgtgaggcgtgaattctctttgggtaggctctgggccggggccatcctcccgcttccctggtggagcccttctgtgacagcggtcggctccatggcggcggtggccgcggtgagggcctagtgagccctcggcttactctttagctcgagcgg

SEQ ID NO: 375005 - DNA, 729 bp, Homo sapiens
atctaatacaattttacagttcacaaagtaaatgtatgcttttttgtttgctaggcgctaatgtgcatgctacaacagcaacaggagacacagccttaacctatgcttgtgaaaatggacatacggatgttgcagatgttttacttcaagcaggggctgatttagtaagatatttttaatttcaaatatttttgcgttaatgttaatatccatttatacttaacatttagaaaacactaaagatcaatggtttgcgtactttgtatacagtaacttaaaaaagcttggctacctgttctagttgttgtatgtattaaatgtatttgaaaatacttagtgttgaacagggcatactgtttcttttcctaggtaaaactactagtttgtttcttcctttcactccacccccatttgacattcctgtgctttttaaactgccatctgttagatatatcataaattcaatgatgtgttcacagaatagagtaacaagtcaagtcactttgagtgatttattattattttaattgacacatgataattgaacatattaatggggtacagagtgatatttcaatacatgtatataatgtgtaattatcaaatcagagtaattagtacatccatcatcattttgaatgatttctgttgtttctctgattagacatttcaaaacaaagctactattgttaatcatccttctagtacattcctacaaattctattctt

SEQ ID NO: 375006 - DNA, 2114 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcagcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 375007 - DNA, 794 bp, Homo sapiens
  misc_feature (786)..(786): n is a, c, g, or t
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacacgcgcaggcgagcagaagcgggggcagagggggagggnaaggcggg

SEQ ID NO: 375008 - DNA, 2187 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgagtgtgcctctggcagtgacgaggacgaagtgtccggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 375009 - DNA, 1245 bp, Homo sapiens
gagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgccgggaggggtcggtctggggatccgcaccgtgaggctctttggggaggccgggccagcgtcgggagtcggcagcagcggcggcggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattattaaagtgctccttaatgaaggtgcaaatatagaagatcataatgaaaatggacatactcccttaatggaagcagccagtgcaggtcatgtggaagttgcaagagttcttttagatcatggtgcaggcatcagccgttgcaggaccggctac

SEQ ID NO: 375010 - DNA, 963 bp, Homo sapiens
caatattgatgaacttttgataaggctcagatgagcatgataatatatatgctgtctatgctgaatcttctaatcttgtcttttttcttcctttttccaatctcttgctttcttctctcccacttaaaaaaatctcaaaacaaaaaatttctctccttctttctttacttctgaaaatctgcaggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggta

SEQ ID NO: 375011 - DNA, 1809 bp, Homo sapiens
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagactaatatgccttgggtgcgactgggcgtgctcggagctcgcagacgctcggaggcatggcggctgcggagccggcggtccttgcgctccccacagcggcgccgtgggcgcggaggcgccgtcgggcacagtccctgtgctcttctggttctcagtcttcgcgcgaccctcgtcggtgccacacggggcgggctacgagctgctcc

SEQ ID NO: 375012 - DNA, 1754 bp, Homo sapiens
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcgccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaaggtgctctctcttgagttgaccgagagtcccattagggatagggagacttaaatgcatccacaggggcacaggcagagttgagcacataaacggaggcccaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagggaagattgcattcttctactggatttgggctctcagagggcgttgtgggaaccaggcccctcacagaatcaaatggtcccaaccagggagaaagaaaatagtcttttttttttttttaatagagatgggggtctcactatgctgcccaggctggtcttgaactcctgggttcaagtgatcctcctgcctcagcctcccaaagtgctgggattacagtgtgagccactgcgcttggccagaaatggttttgatctgtctgaactgaaccctactgcttaggcatagccccatccttgataatctatttgctcccaaggaccaagtccaagatccttacaagaaaggtctgccagaaagtaaatactgcccccactccctgaagtttatgaggatgataagaaaacataacagataaagacaaacccccgctaactttatgccagat

SEQ ID NO: 375013 - DNA, 1471 bp, Homo sapiens
atgtttgctttcatcataacagcttgttatcaaggatgaatttctccctgaaattaatggaggcacagactggaaagtttaaagtggctttaagaggttattttatttagtcctctgtcttaatagaagcaaattattatctctgctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaaggtgctctctcttgagttgaccgagagtcccattagggatagggagacttaaatgcatccacaggggcacaggcagagttgagcacataaacggaggcccaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagggaagattgcattcttctactggatttgggctctcagagggcgttgtgggaaccaggcccctcacagaatcaaatggtcccaaccagggagaaagaaaatagtcttttttttttttttaatagagatgggggtctcactatgctgcccaggctggtcttgaactcctgggttcaagtgatcctcctgcctcagcctcccaaagtgctgggattacagtgtgagccactgcgcttggccagaaatggttttgatctgtctgaactgaaccctactgcttaggcatagccccatccttgataatctatttgctcccaaggaccaagtccaagatccttacaagaaaggtctgccagaaagtaaatactgcccccactccctgaagtttatgaggatgataagaaaacataacagataaagacaaacccccgctaactttatgccagat

SEQ ID NO: 375014 - DNA, 635 bp, Homo sapiens
tgcaatgtgatctgaagtttctaattctggcccaactaaatttctagctctgtttccctaaacaaataatttggtttctctgtgcctgcattttccctttggagaaggtgctctctcttgagttgaccgagagtcccattagggatagggagacttaaatgcatccacaggggcacaggcagagttgagcacataaacggaggcccacaatcagcatagaaccagaaagattcagagttggccaagaatgaacattggctaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagg

SEQ ID NO: 375015 - DNA, 4110 bp, Homo sapiens
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccctaccacagcgtcccgcgtagctggcactacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaaggtgctctctcttgagttgaccgagagtcccattagggatagggagacttaaatgcatccacaggggcacaggcagagttgagcacataaacggaggcccaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagtcacagcaccaaggaatgctcaagggagctattgcaggtttctctgctaagagatttatttcatcctgggtgcagggttcgacctccaaaggcctcaaatcatcaccgtatcaatggatttcctgagggtaagctccgctatttcacacctgaactccggagtctgtatattcagggaagattgcattcttctactggatttgggctctcagagggcgttgtgggaaccaggcccctcacagaatcaaatggtcccaaccagggagaaagaaaatagtcttttttttttttttaatagagatgggggtctcactatgctgcccaggctggtcttgaactcctgggttcaagtgatcctcctgcctcagcctcccaaagtgctgggattacagtgtgagccactgcgcttggccagaaatggttttgatctgtctgaactgaaccctactgcttaggcatagccccatccttgataatctatttgctcccaaggaccaagtccaagatccttacaagaaaggtctgccagaaagtaaatactgcccccactccctgaagtttatgaggatgataagaaaacataacagataaagacaaacccccgctaactttatgccagat

SEQ ID NO: 375016 - DNA, 195 bp, Homo sapiens
tgggggcactgcttgcttgtaatgcataacttgacgggagacagacatgtgagaagagaactgtgatcccaaatgataagtggatgccaagcattcttgagaggaaggaggtgggcatggaatattagaagtagcttcatagtggccaggtgcggtggagcatgcctataatgccagcactttgggaggccgagg

SEQ ID NO: 375017 - DNA, 167 bp, Homo sapiens
gaacaagagaagcctggttcttcggctctttcttgcccttctaataaataccttctctgattaaggcagctgcagtcaatgccttttttttgcaaccaaccctcaacccctgacagatgtatcttttaattgcattaattcatcctacaggtttttgctaacagcag

SEQ ID NO: 375018 - DNA, 441 bp, Homo sapiens
ttttaatttttccctaattctgtaattggtattccggttgctcgtgggagccggaagtctggaattcagataactaaggtgtttctgtagttgtctgaattgttaggcatttgtaaaatataaaacagaaacttgttcaagcacaaccacatgctccaaacctaaatatgccagagagattttcgcaatagtcatctcttgtgttaagagtcactccattacaggaaaaagattcagaacgatttccatacaagaatcctcgtttttgtagggaagtttcccaagagccagggccagctgtgctccattattaggttaatgcttgatttgtaccttatttttatttttcatttctgaattgaaataaaagttatgtaacctaaattaagacttggcatagcttgcagtccaattcctaccctcatatgagatgcaaggttt

SEQ ID NO: 375019 - DNA, 387 bp, Homo sapiens
tagatggacatatccttatatcacttagtagaaatggaagttcggaattaggaaatttgcccagcatcacatggctcattatgtctacaagatatatgcagtgttgtcaagatgtcagttcttcccatcttgatctataggtttatccctacttaatttgtaggttcaatgcattcccaatcaaaatccccgcaagttattttgtggatatcagcaaactgattataaagtttatatggagagacgggagacccagaatagccaacacaatattgaagaacaaagtcagagaactgacactacccagcttcaagacttactctgaaactacactaatccataaagtgtggtattggtgaaagtatagacagatcgatcaatgaatca

SEQ ID NO: 375020 - DNA, 437 bp, Homo sapiens
agtcgagcagacaggctccgtgagatgtctcatgaccagtaggcggtggagcatcagcgtttctattcttgccagtcagttgtcctgccgcactcttagcatggagccctttgctcttgtgaaaaaaaaatgagggattaaagttcagtcttttttggccaggcgcggtggctcacgcctgtaatcccagcactctgggaggctgaggcaggcagatcacgaggtcgggagatcaagaccatcctggctaacacggtgaaatcccgtctctactaaaaatgcaaaaaaattagccaggcgtggtggcgggcacgtgtagtcccagctactgggagtctgaggcaggaaaatggcgtgaacccaggaggcagagcttgcagtgagctgagatcacgccactgcactccagcctgggcgacagagcaagactccatctc

SEQ ID NO: 375021 - DNA, 485 bp, Homo sapiens
gttcgatacatccctagacgagatcctggaactgaaaagcagcagaagggggcgtccaaggcccaaaacaaaaggcaagccttgcccagaaaggcctagctggagaagccaggggacacatgtgggcctggccacgggctccgatcctggctccatgacccgcctggcaggggagtgggggacggtgagaacagcagagcagatctcaaggaggcatcgaacctcgatgctcactcgtctgctggccctgctcctcgtgggcctctcctgctcgtgtggacctctctgcctggccaaaatggtgaaaccacgtctttactaaaaaacacaaaaattagctgggcgtggtggcgggtgcccataatcccagctactcaggaggctgaggcagggagaattgcttgaacctgggaagcggaggttgcagtgagccgagattgcaccactgcactccagcctggcaacagagtgagactcagtctcag

SEQ ID NO: 375022 - DNA, 560 bp, Homo sapiens
gtttggagaggttttttttaccccctcttcctacctgccgaaaacctttcagacacactggagatagttaagcttccctgatttcttgtgtttccgggagcgttttaaggttaatagtgcgtgccacttacactagagcttcacagagaagcagtctctcgaggttggttacttgctgttggaatctgcagtctgcctttctgctgcacggatgcgaatttagaaggttttgcggtatgacggaggggaaggcgtagcatagcagagggcaaaactcagcagtatgactgggtcaagtctcgtaacccatgagcctagctcccttgtctctgaatggcattccggacaacagggtttgctgggtgcttgcggtgtatcggcacgcactaggcacttagccgggggcgggggagttgttctggtgagggagacatggatatgttcctgcctcatcaaagtgaagtcatttaacaggcatggtggccacccgcgcgcagctcagtgctgggccccagggacacagaaataaagagaacacagttcccattctccttcctgga

SEQ ID NO: 375023 - DNA, 295 bp, Homo sapiens
taacagaatagttgaagtgggaaaaccatttgagaagaccatatttactgtgactatcaattgtgtttccttagaaacaaacccctcagaggaagaaaaaaagtaacatttattactgtttagtaaatattaggtgacatatttaatgaaatcatcagtttgggtcaataattcataagaagaggttgagattagaaataaaagcattttcctttattcaaattttttatgtttactgttatatattagataaatcttagcaattttcacttttacgtaagcacaagatgtttag

SEQ ID NO: 375024 - DNA, 373 bp, Homo sapiens
ggaggctcgaatccacagctacaggaggacggggctcccactagctccatggagtgtgcagccccggtggcacctccctgctgctgctgacatgatggcatcagccactgccatcaacaggtgggatccagcaccttcccctggagagcaggcagtgctgcccaggaaggcatcctcctctttacctgaaagaatatttctgtaactgtgataaaacacacatgaaatacatatgaactttaccatcttagccgttgataaaacacacatgaaatacatatgaactttaccgtcttagctgttgataaaacacacatgaaatacatatgaactttaccatcttagccgttgatgaaacacatgaaatacatat

SEQ ID NO: 375025 - DNA, 414 bp, Homo sapiens
gcgaagggggtgatgttgaagactgctggagactaaactgtgtgtgttggaggaaagggggaaagctcagctctccctatttctcctccaactatttggtaagactcggtgatagaaaaacatctcctatacgaatggccttggtatgaacagccgcttgggatgacaggccactatcccactaccccttgagtctttctgagctgctcacctggtgccagagaactggcagataagtttctgcagctttgctcactgccatgaggggggctagacatcacactttgggtgaggggtaaacaaatccagagattgtagggcaacataagttaccaactggcagttgcacccatgactgtctttcctgaggcgctgagtagtgatttagccagatgacagaaatacctttcgagt

SEQ ID NO: 375026 - DNA, 331 bp, Homo sapiens
caccttcgagatagaataaatacagcacccttctctaccaagttaggaaaggaagaagtgttaccaattagttgtatggggactgccaaagcacgccattctgaagatgagcagaaactggctcattccatttggcacctagcacactaactgcaccagttaataggccacgcttttctccagagccattggctgaagagttcaaataaaaagtattgagaataggctatccaaaacagtaggctcagatgctatcacacaaagcactttatccttaagttcaatttttctaaattgtagttggctgctttggcttaataaaaaccttcca

SEQ ID NO: 375027 - DNA, 491 bp, Homo sapiens
cattttctattttagtcctgtgagatactaatttggatttcattgtgcccattgagcggcttttgttctttggctgtgagtttaattatttagttatttatgagtgcatctgggcataagtgccacagttttatttcggtgacaaatttatggtcagtgaattttagtaattaatgaataaattatttctcctccataaatgcccctgcaatttctgattttcataacaattcataatacttaagaaaaattctttattagttgaaaaagccaatgctaatggaatcaggaaaaggagatttcaaattgctttaattaactgtattaattagtatccaatatgtgtaagatattgaattggctttggttgtctctcttagcatttagttgcctaaaatctgtttaagatatgaatatactgtgttaaaataaattctaattcttttgtgaagtaaatggcaagaataaaaggatctcctttataatcttta

SEQ ID NO: 375028 - DNA, 1245 bp, Homo sapiens
gggagatggagagcagggtggaggcaggcggcttgcggcgcgcaagtctcctcttccccggccggctcccggctgcgagctctgccagctcagaatttgcaaagaatctgcggtttggccacccacggcagcttcagcttaaccaaagaatgagccccaggcaaagttacccccaggcaagaggcgatgggtggaggaggaggtacatgcagcgggcagccgggcccatagccagcctccttccgccgtgcagccccctccccaggggccagagccggccgaagactgggggtagggacggagtcgggggacgggatttttttccagagcaacaggtaggctggtgaggaggcctccggcccagggagaggcgctgagaaggctgcgggtgaacgggagggtcgagggcacacgtgagtgacagcaccttgcactgaaggggacagggcttcctcgagctctgccctgtcccctccacctgtccggagttcggcccgggagcaccccaccccgcagagggcgccactcccggcttcctggagacgcaggaagccctgggggcgcagccatcccacagcgcggccgaggtgggactgggggtcccgcagcgaccgcttttctttggtgggtctgcacgcacctatccgggcaggcggggaaaggggccgggcggccacctatctcctgaggcccgcaaagaccgcccgctctcctccaggtctggccagctactaagacgatcctccgcccgaggctgacggaagtgcttcgccgaggcccgcgccatgctctcctcctcagaaagcgtgaaagaaaaccctaacccaaagcatgagggagtggggattgagcggccgctggcccgcccccgaaggccattgattggaggagactggacacagcgccggaagttttccttgagtcacatgattggctgggagaaacagaagctccgcccgaccgcagcgcagattggtgccaggcccggccggtcccccagtctcgtgattggcggggcacagcagacgcccctgggctgcagcatgattggtcgcgggttgctggtcctgggtcccgggccggagccccggtgcccgatagatgggccggaagggtcgcggcgaggcccggctcagttgccccggtagacttcgatcttgctggccttggccagcatgtcgatgatgtgggcctcgaagtccgcgtcgtgcacgccagtcttccggaactcgcccgcgtaccggt

SEQ ID NO: 375029 - DNA, 425 bp, Homo sapiens
gaaaagaaattgtctctaggtgggattatgggatttgtttgaatcattcttttgcatgtttctattttctgacgtttctgtaagagtatcagttgcttttggcacaagataaaaacaaagaataaaagaaaggataaggccaggtgcagtggcttatgcctgtaatcccaggactttgggaggccaaggcaggtggatcatttgaggtcaggagttcaagaccagcctgggcacagggacatggtgagaccctgtctctactaaatatacaaaaattagtcaggcctggtggctcatgcctgtaatcctagctacttgggaggctgaggcaggagaatcgcttgaacccaagaggtgaaagttgcagtgagctgagatcacaccactgcactctagcctggacaacagagagagactctgtctca

SEQ ID NO: 375030 - DNA, 374 bp, Homo sapiens
caatgtctctttggaggcagacctttatttggagaagaacataaataacttaaagccagatatggaaagtctctgtttgttcatttttaaattagccatatcccttctctacattgcaaggttgggtaatgtttgctcattaactctgtatctgcttgcagagcttgtcagtcaatttcatgtagttgtcagctcgcaggcagggctccctgccagccacaacagagtcccatttaccctcaatgcagcagacctatggtactccactgcaggtactctgggaactgacagtggactgacagcaaatgtctggcatggtagaagtagagtgggcacttacagagtctgggcttgagagggaaaagatggtttag

SEQ ID NO: 375031 - DNA, 801 bp, Homo sapiens
cctgtaatcccaacactttgggaggccaaggagagtgaattgcttgagcccgagtttgagaccagcctgggtaacatggtgaaactgtttctgcaaaagaaaagaaattagctaggtggggtggtgcatacctatagtcccagctacttgggaggctgaagtgggagaatcacttgagcccaggaggccgaggctgcagtgagctatgattgtgccactgcacttcagcctgggtgacagagcgagaccctctcaaaaataataataaataagtcacatgaacaaatacgtcaacagacctcttcagcgttggcttatcttagagcccactgtggacctcaagccctcgcagaaacaacggcaggtacagccatgcagagtgctgtttcacactgtgaggaaaacgagggctggcggtgctggtgagtttcaggagagggttgtttttatgcactgtgtttgttttctcattgcagggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375032 - DNA, 1185 bp, Homo sapiens
gggcgcgtctttcccaccacgaggccaccaggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375033 - DNA, 1206 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375034 - DNA, 1515 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375035 - DNA, 979 bp, Homo sapiens
ggccacgaccgtatgcggcaccaatgacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375036 - DNA, 1057 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgagggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375037 - DNA, 847 bp, Homo sapiens
ctgcgggtgactcagaggatccccgagggtgaccttcgggcgggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375038 - DNA, 1147 bp, Homo sapiens
gggcgcgtctttcccaccacgaggccaccaggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggagcactggccagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375039 - DNA, 986 bp, Homo sapiens
gggcgcgtctttcccaccacgaggccaccaggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375040 - DNA, 904 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375041 - DNA, 1191 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375042 - DNA, 1018 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctctttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375043 - DNA, 688 bp, Homo sapiens
gggcgcgtctttcccaccacgaggccaccaggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctctttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375044 - DNA, 587 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgagggatggacagattcctggtgaaaggggctcaagggggccttttgaggaagcaggaggagcaagagccaactggagaagagccagctctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375045 - DNA, 1316 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaactttaaaatgaaaatgtgaaactaggaatgttgctgtgagaccccttggacaaacagatttttgcactggggatagaacttgagcaatttctgtcttggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375046 - DNA, 858 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgagggatggacagattcctggtgaaaggggctcaagggggccttttgaggaagcaggaggagcaagagccaactggagaagagccagctgtgttgggaggagacaaagaaagcacaaggaagaggcccaggagagaggccccagggaatggaggccactcagcaggccctagctggcggcacattcgggctgagggcctggactgcagttacacagtcctgtttggcaaagctgaggcagatgagattttccaagagttggagaaagaagtagaatattttacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 375047 - DNA, 460 bp, Homo sapiens
tatgctccctccctccccttaccttggaacccaggccagtggcccatctccattcatgcacaatctgttttgagtctcagccatgggttccccagaatgggtaagcaaggagccttgtgtgggcagtggtcggctacccctggatgggcccttactgccccgtgtgtattttctaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctc

SEQ ID NO: 375048 - DNA, 1675 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatcc

SEQ ID NO: 375049 - DNA, 1950 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctcaaaaaaaaaaaaaaaaaaaaaaaaaaaaaaaaaaaaaaaaaaaaaaaaaaaaaaaaaaaaaaaaaaaaaaaaaaaaagagggggggggggcggcaaaagtaccccccgggggggcgccattggcccgcccccccgaagtattatagcaacagaaaggggggcgccccataatagggaggcgcggtactaataataacagtcgaagacgaggccgacgcgcacacatacaacaacacgagagcagagacgagaaacaacaagcgacaggaggacatactataggtagcaagacacaacaccatatagcacgcggggggggcaacaccaataaggagggaggcgaccacacacacccaggagaaggatagataccagaccccgctcagaggcgagaaaaaataaacacacgactcacgcagggctaggaaggggggagaaaaaccaaccgctcgcgtcagaaatagagcggccggagagagcagacgacatactcacggagcaccagcaggggagcatgtataacaggagaaaacgaatatactacacacggggcgggcagcttcggtatcaacaacgggaag

SEQ ID NO: 375050 - DNA, 1116 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgaactggccatttgccaattttcctactctcacactggttctcaatgaaaaatagtgtctttgtgattttgagtaaagctcctatctgttttctc

SEQ ID NO: 375051 - DNA, 1327 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatggctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattcttttattggataaaaaattaaacattttcctgtgatggtatttttcaaagctcgcatgcatttcatcttgtataaatgtattatttacctagccaactctgtat

SEQ ID NO: 375052 - DNA, 1218 bp, Homo sapiens
ctttgactgtccttggacgtaaatcttttttgaccattcctggtttttttggtagaataaattctttgagttggaattgctgggtgatgtttaaagctcttgctacgtgttgtgaaatctgtgtctgtagctcgtggctgtgataaacatcctcagagatccctgctatccaactcttgtcaccagctaactggtcattaggccaagctgtgtgagtgaaccattagacaatttgataaaaataagcactgctgccattctttagcatgcgtctgtgccacaagttagtgacacatgtacatatattccctttacctcacagtaaccatctagggtgtgggcatcataatcttcatttttaaaatgagggtactgaggcatgaataggctaaataatttgctcaagatcacaagttagtaaatggcagtcagttttcaggcgtaggctttgaagactctaaacctgtgcttttaacatctgcctcttcttgtgactgggggcttcactggagccaagcctcaggaggcatttgcagccacagtgggtcatgcgaggtagagcagactgcaacctgatagaattcttggactggcccacggccagcctttttaatttttccaagagttaaagttgtggatctgagatgtggcctggcctgccagggctatggtgggctcagtgtgattgcatcattagtattgtggcatggagtcttccgtcagcctcagagaacccttgcaataatgcattatttccccgcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctc

SEQ ID NO: 375053 - DNA, 776 bp, Homo sapiens
gccattgaaaatcattaactcttttgcagatgatagtaatgatatctctagcctgatgcttcattcttgaaggtgaactgcactgtgtacttctgttggccagggtgggtgtaaagaagcagcagcaggcacttttcctgtcacaatgagcccatggtgtggccagggcagagtatccatacataggaaacaataaaagaacaaagtctgtgttaaagatcagttcctatggcccagacattgagaacacagggagcttttatagggacaagagccatggaaaggccatacaggatacagacccagggaaagggttcctgaaaatggatatcacatttacattggtgacctgtgacctgttttgtgtactgtgggtgtttcttatgtgctctcatgtcattttcactgaggattatttgttacatgtttactatttactaacttgtattatcaacttactcttccatagatcctgccagaaaatttcaaagacagtagattgaaaaggaaaggcttggtaaaaaaggttcaggtgagttgtgtaatagtgcacgacaaggtgtaatatgttaatgtgtaggtatgtgtgtttatctgttcaaaatcaggtagtgtaggagcgtggtgtgtggtatgggcttgttttggttatatttatcagcaggaaccccaaacgtcagagaagagccacctgtgtccctgtaattatatttgaatttaaactatttagggagggaactcactggagagcaggtagggctgacacattacacaat

SEQ ID NO: 375054 - DNA, 450 bp, Homo sapiens
gagtgcagtggtgcaatctcagtggctccctgtagcctctgcctgccaggttcaagtgattctgcctcagcctcccgagtagctgggattacaggtgccgcctgccaccacatctgtctgatttttttgtatttttaatagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatggctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattc

SEQ ID NO: 375055 - DNA, 405 bp, Homo sapiens
ccgatgaagatgccgttttcgccgatgaagaagccgttttcgggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctc

SEQ ID NO: 375056 - DNA, 1369 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctc

SEQ ID NO: 375057 - DNA, 1415 bp, Homo sapiens
  misc_feature (1381)..(1381): n is a, c, g, or t
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctcaaaaaaaaaaanaaagggggcgggctcggaatcctaagaacaggta

SEQ ID NO: 375058 - DNA, 1549 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggatcaaagaagacaggcatgaggctaccttctcaggagctgtagtgtaccattcagggacctggcacagtccatccagacatcctgctgagcgtcgcccacatatgcagtctcggacctatgtcctacctgttcatgcagttgtccatatccagtgggatgtcctaggggctcaactgtccacaaacatcactgccccccacagaactggtacagacccccaaaccacccatctcagcccatgaaaccactggccacccaagcccacaaatcagaaaccagtatgctgcctccttcccctcagcctttacatacagtcacataccaagcctgtcaattccactcccaatgtacctcctaaccatgagtctttgattagcatgatctttctctaagctaggacaacatcctgatgttccttatatttcctcaaatacaaactttcacatctatccagaaattgca

SEQ ID NO: 375059 - DNA, 855 bp, Homo sapiens
ggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaaggttcttcaacagatatttattgaggacctgctaggtattggacactctcaaacacctggacaggtgtcagatttgaagtcttatgatgatggcagaaatctcaccattttcgatgaagctcatgggcagtcttccctcg

SEQ ID NO: 375060 - DNA, 301 bp, Homo sapiens
ttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggccggccccatcctgtaggctcttggctcactgtccc

SEQ ID NO: 375061 - DNA, 196 bp, Homo sapiens
aaagaggcagaatggaatacacaagaactgtggaacaattacaaaacgtgcaacatttacataatgcaaacatcagaaggataagagagaaacagaaaaaatatttcaagtaataatggctggggactttccaaaactaacgaaaggcaccaaaccacagatgtagggagctcagtgaatacgaagcaggataaat

SEQ ID NO: 375062 - DNA, 1890 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375063 - DNA, 465 bp, Homo sapiens
  misc_feature (33)..(33): n is a, c, g, or t
  misc_feature (48)..(48): n is a, c, g, or t
gggaacccttgggcctttgggtccttttctttntttattcccaaaagnaaggggggtataagggggcccccttgtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375064 - DNA, 1851 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375065 - DNA, 894 bp, Homo sapiens
cagtgtcctcccacattgattctatatctcatcttctcaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375066 - DNA, 2006 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggtctgagtctagctttgcgtttggaaagacactccttgcccgaaagtacagctgtagaacttataagagggagtcagaggaaggtgttggcttttttatgcttatggcctatctgtgcagaacaacagagtacaataatattggcttttccttaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375067 - DNA, 911 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggcaattgaaggaacagactaaaaatcgtgtcctggaaggaaactacaggtactaccaggggattttccagtctgagg

SEQ ID NO: 375068 - DNA, 193 bp, Homo sapiens
ctgttactcttagggaactatcttatgtgtggcatttcctttgcagttgggaaaatgggacagcacagcctggtggcttgttcaggcaatctcaacaaggccaaggaaatctttcagaagaagtgagtgctgaaaagtgactacaaaaaaatataccctcctcttcttagatgtatattctctaaaaaatttt

SEQ ID NO: 375069 - DNA, 222 bp, Homo sapiens
tatggcctatctgtgcagaacaacagagtacaataatattggcttttccttaggatgcttctatggcatggttccaggatgagtaactgggtgggaatcttgagccatgggcttcgaattgccccacctgaagctcccatcacaggttacatggtgagtgaaattgaactctgggaggagcacaggggaaagggatacagtaatgttctcagtgcttttttt

SEQ ID NO: 375070 - DNA, 400 bp, Homo sapiens
cccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375071 - DNA, 2007 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375072 - DNA, 1224 bp, Homo sapiens
ctgtgtttgtgccacggcactcagcctgggcaacaggagtgagaccccatcttaaaaacaggaaaaaaaaaagttgaaagatgaaagtcttttttagggaaggatgttaagtacagttcactagatgggatcctagtttggagtctgatctctgggtgggcctgcagggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375073 - DNA, 2214 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtgagacaggagtatgtctgtgatctctagtttattaattccagtttttttccgatgagaaaagtttgaccccagaaccaagaggtttacctgggatagcttgagagaggaccaagtacaatttctagtacattggattcctctgctggagtaggggaaaaaagtactgatgggattttctgtttggctttggagccatctaattcttagtaggatatgggaattcaaaggttttttgctttgcaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtcta

SEQ ID NO: 375074 - DNA, 765 bp, Homo sapiens
  misc_feature (23)..(23): n is a, c, g, or t
agcgggttgatgacgtcagcgtncgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaggagcctaaaatggaatgttgtgaactcacacattgaataagtgaataggacaggattaacctgcacaagagattaggaaggaagcagtcatggaggtgagtggagatacaagagagtgctgtgtaatgaaattcctaggataatagtagtatcaaaggtgggagtactcagcgatggacaaatcatgctagggtaaatacatattgacgaggtgctgagtgttccgccgattaatt

SEQ ID NO: 375075 - DNA, 418 bp, Homo sapiens
agtctacatcagcctttttgtcttatttttcacaggtgatttcccagtacctacaatctacccatgctcccacacacagcgactataccatgaccttgctggatttgtttgaagtggagaaggatggtgagaaagaagccttcagagaggaccttcataacaggtctgagtctagctttgcgtttggaaagacactccttgcccgaaagtacagctgtagaacttataagagggagtcagaggaaggtgttggcttttttatgcttatggcctatctgtgcagaacaacagagtacaataatattggcttttccttaggatgcttctatggcatggttccaggatgagtaactgggtgggaatcttgagccatgggcttcgaattgccccacctgaagctcccatcacaggttacatg

SEQ ID NO: 375076 - DNA, 224 bp, Homo sapiens
tcctacatgtatttccaggacagaatatattatctctgccctgctgggccctttgtttttgaagtcagagtattggatgatttttatgggtaggacagagcaaaccaacacttacttcaaaatgctgaatgtagattaaaagatattcatttccattagaaataaagcaagatcgtatgcatatgtcctaccagttaaaggattctgtatcttaaagcctcaaa

SEQ ID NO: 375077 - DNA, 395 bp, Homo sapiens
gacttctaggaggtcctgtctgaggtagaatcagaaatggcttccctccattctaccagaaactgggaatgtgctggagattcaaagcacatcccaatgccactcctcatatactcaccactcttccctaaatcagctccagcgctgagtagggttaaggccttccctcacggcctggattgataggtttcccagtggaagtgtatatcttagagtcagtttaccctcctgtcacaccctggaaacttacaattttctgcctagcttatggtgtaagctgcatcctgccgtttctttcacatggtctgtggcttatttcaattttcctgttaaattcctgtgttgcttcttgaaagaaagttcacagtgtgagtctctacatgccattttgtctt

SEQ ID NO: 375078 - DNA, 508 bp, Homo sapiens
caggaacttttcccacaacttctccagccttattttcatattagctcttgaatgctcttgattttgatgccagccagtcttcttccacccaggggtagcaggctcagctttgccctagagtgtaaagtgaacattcagaaaaggagccaggttttcccatgactgttatggaatcttaacattgtatttgaagcacgattaggaagtgctgggcttgtaacaatcacagccagggttcatacgtccagattgttctttttaagtgcatcagctgaactaattgcttatattccagtgataccgccagtgttctgcattcttttaaatgaacttcatcgcaatcaccttataaccccttccccactcccactgctgagcacagtgtcttccaccaaatgggtggttcaaaaaagttggttgttagcactttgggaggctgaggtgggcagatcatgaggtcaggagatcaagaccatcctggctaacatggtgaaaccccgtctctact

SEQ ID NO: 375079 - DNA, 205 bp, Homo sapiens
cattttccttctcttgaatgaactgttttaaatagtgagccaggtgcccaaagccaagatctcaaagaagtaagtattttaggaaaaaagaaaggaccacgtttactttgggcatagcactttctcgtcctcattagtttcttctttacttagtaggtaactatgcaatgagctcaaaccgacccatcatcccaagaatggaaaa

SEQ ID NO: 375080 - DNA, 545 bp, Homo sapiens
aacgtctgtttctattcagcggattttctaatttctttgatcagcctaaatattttcttggcaaacggaaattgaccatgccatgaatatgataacaacctgcttggaaaaaaagctattttgtttccaagcagcagaaaaaaaggggtggggggacggtgaaggaggctggctgttaggaatgcctgtaacagattccagcacatacatctttttgcagtctctgaagcagctttgtgaaaactgccttttctctctcgtgaagcttctttccttcctctcctcctctcagttaaacacacacctggtctcctaaaagcctttgatactctttattaaaaaatagaacttcaatggatgcctcaggagactttccctttaaaacatagatgaaaggcaaggttaatacaatgttctcttaatccctttgccttctgagtcaaaataaatattttcttctgcatgtgattgtacatcctgccatttggctatggctataagcaaattgacggtaataaaaatgttttgaggctgtgaaaaaaatg

SEQ ID NO: 375081 - DNA, 378 bp, Homo sapiens
ggacactccttcaatgcttagccaggccattcacaactctctgccttagccttgcttcctacttgtactgagcctaaaggtcaaccagtggtgaaagtgtctggtcttctcaggtcttttctgaacatgcatcttgctctgtgcatgcactttctagtttccctggtatacatgggaaattttccaagcccttatgccccccatcccggttctgggagagcattgttattaagggatgcatgacaggaatgttgggcagaactgggaaagtattaaaaaagcattatcaggacagtcttggatattataacattttcaggaaatatgattaaaaaataattaaacttaaaacccctggattttccaaaagttttaaaa

SEQ ID NO: 375082 - DNA, 2222 bp, Homo sapiens
caaaaacgtctgcctttgtgagtttatatcatagtggaaggaaatagacaataaaaataagtaaaatatagacattggtatgtagatggtgataaatgataaggagaaatataaagacagatcggaagtgacaacagtggggaagtggaattggtatctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacgtacgtgctgggctcggaaatgaaccgatttccgggcgctcttgtggtggggctcaaggtctcaggagttctgtccttcccagattgcccacaaggagctttacacctcgctttcatcagtggtttgtctccgagagggtggtcgctcatcgtgtgcccattctacagagaagggaagtcgtgtaacaaaaacttagtggggatcccacagccaattatttgctccttgttccaaggtacaatgacatgatgggaaggctgaatgtgtattaagtgctaagttctgtcagtaagcaggtggtaaaagtcctctcccaggtacctccgccctccccgccccgcccaaggttgtttattcctgaccttggctgatgatggggaatgggggtcatggcaggagcagcgttctggtccaattagaggactggattaaagaattaattcagggccgggagctggggcttacgcctgtaatcccagcactttgggaggccgaggcaggaggattgcttgagcccaggagttcgagaccagcctgggtaacataatgagccctcttctctaccaaaaagaagaaaaagaaaagaatccggagaaaaaaaccttgggcttgcattgctctttctaatgccaccagcctcgtctggcaggtgagggagtcatttctttgcattgtaaacttgggttaggccacgctagggaggtggtaggtagaatagctaaagttgaccacaaagaaggatgatctggagagccctggctgtgttttaggggactgggtgggagctcatttc

SEQ ID NO: 375083 - DNA, 3831 bp, Homo sapiens
caaaaacgtctgcctttgtgagtttatatcatagtggaaggaaatagacaataaaaataagtaaaatatagacattggtatgtagatggtgataaatgataaggagaaatataaagacagatcggaagtgacaacagtggggaagtggaattggtatctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaaggtacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375084 - DNA, 3315 bp, Homo sapiens
  misc_feature (2259)..(2259): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagtta

SEQ ID NO: 375085 - DNA, 5348 bp, Homo sapiens
  misc_feature (3842)..(3842): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375086 - DNA, 3546 bp, Homo sapiens
  misc_feature (2040)..(2040): n is a, c, g, or t
atctcagctatgctgaaacctgtttggaaaaacatgatttaactttagaaaataaaacttttaatacttaagagataacatgatgcaaacgttgcttgttggcctgactttccaggactaagaccctctgggaatcaactggggctcggtgacatggcgtaacctgctactggggtgtggtctcagacacaaaatcacactggatgttggtctacagaggcaggattctctcattgctggatgactcttgaaatgaagcctttgcctttgttacacatttggctttacaatcttcattgacaaatagttcggcaaagagtagaggagcacggccacgaagagcagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375087 - DNA, 5344 bp, Homo sapiens
  misc_feature (3989)..(3989): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375088 - DNA, 3860 bp, Homo sapiens
  misc_feature (2354)..(2354): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgaccccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375089 - DNA, 1795 bp, Homo sapiens
  misc_feature (26)..(26): n is a, c, g, or t
  misc_feature (289)..(289): n is a, c, g, or t
acagcagcaatgtaataagtggatantagcggctgtcggtcgaattctgggatgttcactctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375090 - DNA, 3176 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctcccttacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375091 - DNA, 3249 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375092 - DNA, 3802 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctcactccagtctgggcgacggagtgagattctgtctcaaaaaa

SEQ ID NO: 375093 - DNA, 3373 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgaacccgggaggcaagggttgcagtgagctgagatcgcaccattgcactcccacctgggcaacaaagagtgaaacttggtctcagaaacgaaacaaaacacaaaaacctttctcagtcccagcatatgtggagcagcctcattcttcatagctgtgtgtcattccgttgcgtgatggggtcacagagcacagacctggtgcccttttcctttttaatatgtggaaacccctccatgctttccaaagcctacaagtacagcagccccaagtttagggtgagcagcagtggtcagagctctttactattacttttgggcaaacgcaagccaggctggcaaccaccactgccgccgaggggagatacaagcaggccagttcacactctggacgtttagtttctttctacatctagaaggtggcctctgctatccacttaaagcagcccaaggaactgtcagaaagcgaaagtgatgacatgaaccgcgagtagggcacctccctgtgccgtcgtctgctttccttcctccctcccagcctccctgtgccgtcctctctgcgtttgaaacgcagagaggatcagcaagcaggagtatgattccttggtcaacgcgagaacctctctgcgtttgtcctctctcgtttgtcctctctgcgtttg

SEQ ID NO: 375094 - DNA, 184 bp, Homo sapiens
agtctcccagggtgggagatggcagagtgacaggtgagaggggtgggacgttcactgtagtctccctctgccctgcagcttccccttcctccctgcacttcctctacaagctggcccagctcttccgctggatccggaaggctgcattttctcgcctctaccagctccgcatccgtgactgagg

SEQ ID NO: 375095 - DNA, 4059 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaaggtacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375096 - DNA, 5495 bp, Homo sapiens
  misc_feature (3989)..(3989): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375097 - DNA, 5743 bp, Homo sapiens
  misc_feature (4237)..(4237): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375098 - DNA, 4897 bp, Homo sapiens
  misc_feature (3989)..(3989): n is a, c, g, or t
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcggtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttggccgggatggtctcgatctcctgaacttgtgatccacccacctaggcctcccaangtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtagagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatacgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagtta

SEQ ID NO: 375099 - DNA, 4396 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcgggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagccttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggttggtgttgatgcccaaaatagagaaggtgcttgctagcttttccttggtacattttcgggggttgcaaggcaacaagttttcttttgttttgtttgtttgtttgtttgtttgtttttgagatggagtctcgtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaagccccatctctact

SEQ ID NO: 375100 - DNA, 4176 bp, Homo sapiens
gctcttttggttcaaagatgtgtattgagctctactctgctctgcagggacagaactaagtatgtttgctattcaggggatacacagtcattccatgagcaagttacacaatgtaaaataaggacattgtgaaaaacaaaaccataccgtacataatgcactttatagtaaagtactgggaacagagtatttggtaaattgtaactataataataattttaaacagatccacaaatcacacttattattatattctgtttcacccgggctttgccaagcttcccacatttgtactagatcctcttggctttagtttctccccagcccttgtcaccagacatgcacacatccatcttctgggatttccgttctcttgcagaaaagtctgcatttaacgttgttttttaacagcaaattcaggatggggcagagagcagtgagaaaaatgaggcccttatgctcagcgcccccaaccccgcctcggtggggtcactattcattttggaacattgcccttgggaccaacatattctcagtggtccttgtgaaggtttccaccctaagtccctcatcctcaccaggcaatattcattaccctacagcaaactccggaggcaacgcggagaaagtgtgaatcaattcaagactaaggttgccaaaatgtttgatcagctctgcgtcagccttgacattacattacattacagatcccctgatcgccaccgtcgcagaagctctgaattaaaagcgtgcatgtagctgcacatccattgctggcacttcttccgttagcctccgctggaactggttagtgaggacccctccatttcacaagacagcttcggttttgcttcgttttgacttccgcaccccgaagctgtagcaccagtttgttttctcacggcacaggggcggcttccggggcgcggcgtgctgggggttgtagtccgcgctctgcctcctacttccattacagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcagctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgaacccgggaggcaagggttgcagtgagctgagatcgcaccattgcactcccacctgggcaacaaagagtgaaacttggtctcagaaacgaaacaaaacacaaaaacctttctcagtcccagcatatgtggagcagcctcattcttcatagctgtgtgtcattccgttgcgtgatggggtcacagagcacagacctggtgcccttttcctttttaatatgtggaaacccctccatgctttccaaagcctacaagtacagcagccccaagtttagggtgagcagcagtggtcagagctctttactattacttttgggcaaacgcaagccaggctggcaaccaccactgccgccgaggggagatacaagcaggccagttcacactctggacgtttagtttctttctacatctagaaggtggcctctgctatccacttaaagcagcccaaggaactgtcagaaagcgaaagtgatgacatgaaccgcgagtagggcacctccctgtgccgtcgtctgctttccttcctccctcccagcctccctgtgccgtcctctgctttcctccctcccagcacggaaaagccgtggggccgatggactttggcctcacatccacagatggggcctgtgggaattctactgatttactctctggcctagttcaagcaacccacccacggcctggccaaggtcggcctcaccgccctggcctagcacctttggaaactgaatacatggagtgttaaccagaaaaatgtctggcccttttgcctcgctgcctctggaaacctcagtgtttcgggctggtaggaagctacaggacagacagtgggcacggtgcctagcagcctgtcgcgcccccgcccgcctctgcattcctccagcggtggtgtacggatccagacattgtttgccacctctaggcctcttgataaaacagcaagtatttttcttgtcttaaagcaatgcatgtatattttagaaaatattaattgcatagaaggaaatacaggactcgtgatcccaccactcagaaataattactattaatacggttgattttctttcagcttttttccccctaattaattaactaattcttttttttcctgcaactcctgcttcacagacttttttttttttttaacttggcatggtggctcacacctataatcccagcactttgggaggccagagtgggaggattgcttgagccctaggagttcaaagctagcctgggcaacctagtgggaccccatttcttttttttggggggggggtgggttataaaagcccttttataaagccaattttaaacaagaaaaaaacaaaaagtttacaaaagaaaaaaagatacagaaaaagaataacttgcttcatatgtcccaaaaagagaaaaaaataaacgggacaatgccaacatgctcaacaataaagggttctttttcttacttttttaatac

SEQ ID NO: 375101 - DNA, 492 bp, Homo sapiens
acaaagggccctgaaaaaccagtggtccatttccttggtgaaaaagaggtaaacatttcagaatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatactt

SEQ ID NO: 375102 - DNA, 2844 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctttaatcacacaggtgttaaactcaatataa

SEQ ID NO: 375103 - DNA, 2905 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctttaatcacacaggtgttaaactcaatataa

SEQ ID NO: 375104 - DNA, 2787 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataattcatatgtacccttaggaaataaagacctgtgttatcaaaaaaa

SEQ ID NO: 375105 - DNA, 1549 bp, Homo sapiens
  misc_feature (73)..(73): n is a, c, g, or t
  misc_feature (82)..(82): n is a, c, g, or t
  misc_feature (86)..(86): n is a, c, g, or t
  misc_feature (113)..(113): n is a, c, g, or t
ctcctgtccatgtaggcaataaataacttttcttacgtacaagaaatggaaaggatttaactgagttgaagtnaattaattnattnaaaaaatacattatttgtaaagtcagncagttgacaggagccatgaagcaacatagacatatgaaacatgcataaagacaaggaaacatggaagagttttatatgaccaggatgctgcatagatcttagtctaaacatccagctttagcatagggtgctctttaaaaacattaggctgggtgcggtggctcacacctgtaatcccagcacggcactgttgggatgctttttgatgcagaatattgatttataaaatactgtatctttactgtcccttcagagttcagctaaagaaacgtgcttttaggttttaaaaacagtcccgataattgcatcctccagtggtcctacttaaactgaaaacaaggtattgtcttctttttcacagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataattcatatgtacccttaggaaataaagacctgtgttatcaaaaaaa

SEQ ID NO: 375106 - DNA, 1938 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagacaccacacagcactgtggtgaaacgcagccctttatggcgagcataaagcccggtcgaatcaagctagctaaatcccatatgtggcccgctcactggggcggcaaaactcgaagagtccccatgaaaagggtggcataaaccatcccacggatttcacacacaacgggcacacaacagcccactattcatctcttgattttatgtaaatcattatttatcg

SEQ ID NO: 375107 - DNA, 492 bp, Homo sapiens
ttttttactatttaattttattacaggggcagttttcttctagccctattcaggctagtgcaaaaaaatacagcttgggaagcataactagtccttcgcctatttcttcacccactttctcaccaattgaatttcagataggagagactccactctcaggtatgtctcataataaaatacctagttaaaagttttatactatcaatatttgttattagagaggttcttttaatttgtcttaatgatagagctcaaaatgatcactaaccttctaacatttaggaactttgatttttaaataaaagaacagtttaccttcaaaggctggaattctcaccagtttgtactgtagtgttaaatatagttactttaattagcaatatttacatcaaacactatcaaaggaaatttagcaatttccatttgtgctattgtttttgacatcacaatttcactttggtaaacaacacaactgttacagaaatgcagttt

SEQ ID NO: 375108 - DNA, 714 bp, Homo sapiens
gagacaaggtctcattctgtcacccaggctagagtgtagtggcacgaccacagctcactgtagccttcacctcccagactcaagcagtcttaccacctcagcctcctgagtagctagggctacaggcatgtgccaccacacccagctttttaaaatttttggtagagacagggtctcactatgttgccagggctagtcccaaactcctgggctcgtgcgatcctcccaccttggcctctcaaagtgttgggatgctttttgatgcagaatattgatttataaaatactgtatctttactgtcccttcagagttcagctaaagaaacgtgcttttaggttttaaaaacagtcccgataattgcatcctccagtggtcctacttaaactgaaaacaaggtattgtcttctttttcacagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatact

SEQ ID NO: 375109 - DNA, 2951 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctttaatcacacaggtgttaaactcaatataa

SEQ ID NO: 375110 - DNA, 2010 bp, Homo sapiens
agagtctatgcctgtcgtggaagctggcctggcccccggagctccctggagtcggtactgggggcttcgttttgtacgcaccgttttctctctgtgctatgggagatgtcaaggaatcaaagatgcaaataacaccagaaactccaggaaggatccctgttttaaatccttttgaaagtcctagtgattattctaatctccatgaacaaactctcgccagtccttctgtttttaaatcaacaaaattaccaactccagggaaatttagatggtctattgatcaactagctgtaataaatcctgtagaaatagacccagaagatattcatcgtcaagctttatacttaagtcattctcgaatagataaagatgtggaagacaaaagacaaaaagccattgaagagtttttcactaaagatgtcatcgtaccctctccttggactgatcatgaagggaaacagctttcacaatgtcattccagtaaatgcactaacataaatagtgactctccagttggaaaaaagctgaccattcattctgagaaaagcgatgctgcttgtcagacattgctgtctcttcctgtggattttaatttagaaaatatattaggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatactt

SEQ ID NO: 375111 - DNA, 2563 bp, Homo sapiens
tgaaactataaacattttattgatattatactaacaatgtagcacttaaaaactaaggaataatttaagatgtaaaacatcaaatatgcaattaaactttgccctctttttgggaaaaaattcaaacatagtgcatgctggcttcttaaaagttgagtaacagaagtataattgccctttaaaatgactagctttgccttttctcctattattaaatataggtgactattttagagctgatgaatttgcagatcaatctcctggaaacctcagttcttcatccctcagaagaaagctgtttttagatgggaacggaagcatctccgactccttaccttcggcttctcccggaagtcctcacagtggtgttcaaacatcactagagatgttttattcaatagatttgtctcctgtaaagtgtaggagccccttgcagacaccaagttcggggcagttttcttctagccctattcaggctagtgcaaaaaaatacagcttgggaagcataactagtccttcgcctatttcttcacccactttctcaccaattgaatttcagataggagagactccactctcagaacaaaggaagtttactgttcattctcctgatgcttcatctggaacaaattctaatgggataactaatccgtgtatcagaagtccttatatagatggctgctcgccaattaaaaattggtctcctatgagacttcagatgtatagtggtggtactcagtatcggacctcagtgattcagataccttttactcttgagactcaaggtgaagatgaggaagataaagagaatattccttccacagatgtctcatcacccgccatggatgctgctggaatacacctacggcagtttagtaatgaggcttctacccatggtacacatttggttgtgactgccatgtctgttacacaaaatcagtccagtgcttctgagaaagaattagcactgttgcaggatgttgaaagggagaaagacaataacactgtggatatggttgatcctatagagatagcagatgagaccacttggattaaggagccggttgataatggcagtttacccatgactgattttgtaagtggcattgccttcagtattgaaaactctcatatgtgcatgtcacctcttgctgaaagcagtgtcattccttgtgaaagcagtaacattcagatggatagtggctataatacgcagaattgtggaagcaatattatggatacagttggggcagaaagttactgcaaagaaagtgatgcacaaacatgtgaagttgagagtaaatctcaagcatttaatatgaagcaagaccacacaacacagaggtgttggatgaaaacagcaagcccttttcaatgcagcagtccatagaatacctctgtcagaatcaaagactaagcttaagagttcctcgcatatatcgttgtgcacaggatcaacatgatggtgactgggaaaaaattacttcaagtaacatgcttagctttccctccttaatgtgaaaaatcaagggcttactgacataggaacaacagaaatgctcctggaacttcaagttgctgaattataagtttattttttatcaataaatatttttatacttacattgagtgatgtgtttaacaacaaattgtgacagagctgagtgctcctatcttacagggtcaatgaactacttattaagccttactggtagcactgaatttagcagttctgagaacatgtgaaactatgttaaaactgaaggcactatatatttttacataaaagcttgaacatacagatgaattataacctatgtgaagaaatcttagatataaaactaacttttcaaagatacaaaagaaattaaacaggtttcctgaaattttagttcttggtctgttcacctctgtggggaaaattcttagttccagtgataactgttctagttactacttttaagtatgtaaatactagaaaggtagtactagtgacatcatcacgtgtattgttatctatggggcaaatgtgtggtgcccagaataaaatatacctcatgcctagggtagggacatcctttccagctcaaacgtgggtagggatgtgggagaataagaatgtgggagaaccaagagaaaaagtggggctgggagagtggagttcccgtagggcataggcctgtgaagtaacactggggcagatatgtatgttatatacaactatttttttaaaaaacttatatccatgttgggagtagatgggtatataacagtttggaaatactatctttggagaatgtatttttgtatttataaatcaacttttaaaaactgtctcattcaaaagggaataaagacctgtgttatcaatgtgtcattttcttctttcctccataactgtaccttgaaaccttactgctgacctgcagaaaatgtgccgcgttatgtacctggctcatcttcaacacactaaccatgaacactaatagccattaggggacatggctacagatactacattggaaagttgtctttaatcacacaggtgttaaactcaatataa

SEQ ID NO: 375112 - DNA, 727 bp, Homo sapiens
tttactggcaagtttacaaaattaattttattggccatcctggaatggttagtgaacaaatttgctgtccaggtaaatttgtgaattagctatcatcagaaggaagtgcttttatcttagtaataggcctttttcagaactaaaattaatgacaatccatcctgcttatgccctaggtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggtaagtagagcaagcttgagttgacttgatatgaaggaaagaacacaacatactagcattgatggagcattgcgatggtgtgcccggtaccttcctgtcataactctgattaactcagccacaggacatgctgaaatcttagcagtagactccttctgggtcgtggcagataaaatgagttcacgtcagggctggctctcaggaggcgctcagtgctcgtggctttcctccccggtggacagaaccccggggcagctccccgcgccctgacgcccagagcggagcggcccggagcggagcgaccaccgcacactggacccgaccctagtcggccccgcgcgcccgggtcggggctggaacctgcg

SEQ ID NO: 375113 - DNA, 3100 bp, Homo sapiens
tttactggcaagtttacaaaattaattttattggccatcctggaatggttagtgaacaaatttgctgtccaggtaaatttgtgaattagctatcatcagaaggaagtgcttttatcttagtaataggcctttttcagaactaaaattaatgacaatccatcctgcttatgccctaggtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatttggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaa

SEQ ID NO: 375114 - DNA, 4148 bp, Homo sapiens
gctagtattacaggcatgaggcactgtgcccattactaaacttataattctcattcttcatggatactgaaaaatataatataatcttgtttagaattacatcgttttggcatgatatacaaatattaattccaaatccagcttcagattttagtagacttatgaagtttctatttcatatctttaaatgtcatgttaaattgaccaaataagcagaagaatgttccttacttttttcatgaagccctgagaaattgcataactcagcatttgccttcctagactttattagtacctcctgccagcatgttttgttttcagtatcaatgtactgtttctgcttaagatcttagtatttacttttaaatcctgaatttacatcaaaatataaaataggattgatttgggggatttgctaggtcattctgaggctaagattgtgtgattttgaaatgctatattggataatgtttatgttacagaagtagcaaatgaccatatgacttacggtttttagattaatcagcttgctatgacctctaaaactgtagctccagagcatgcacctttttccttagttagtggcattcccacattagattatctcactccacgactttggcttttgtgaaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatattggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggacatcactgcacaagtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatttggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccactttgttcc

SEQ ID NO: 375115 - DNA, 552 bp, Homo sapiens
tttactggcaagtttacaaaattaattttattggccatcctggaatggttagtgaacaaatttgctgtccaggtaaatttgtgaattagctatcatcagaaggaagtgcttttatcttagtaataggcctttttcagaactaaaattaatgacaatccatcctgcttatgccctaggtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggtaagtagagcaagcttgagttgacttgatatgaaggaaagaacacaacatactagcattgatggagcattgcgatggtgtgcccggtaccttcctgtcataactctgattaactcagccacaggacatgctgaaatcttagcagtagactccttgaggttcttctttttgtgggggggcaaaagtgata

SEQ ID NO: 375116 - DNA, 248 bp, Homo sapiens
ccaatggagtggagcgaagagcagccacgctctatagccagtatacatccaagaatgatgaaaacaggtgacatgctgaaccctgctcgctgtgctgaagacttccccacagcacctgaggctaaaccacaggtccctcaataagctaggcctgtgcagtacagccttttataaacttgaaatggatttgctttaatttttgtaatgttttagatgtttctttgaaaagacaaaaaacaaaaattaca

SEQ ID NO: 375117 - DNA, 313 bp, Homo sapiens
aaccactagcttgtactgaatggctgttcccaccaacactgacacattgctgtacaagattgactttcttgacccattggcagcctctgcagctatttggccccaaataactttgtcattatgcactgccccattggaaacatcactcttttacctatagcacttcatctgcctaattctctgaatcttcatccgcagaacttcaaggtagaatttgctttaaattgtgagtttgttcctgttgaatttcatgaaatccggcaagtgaaagccagttttaagaagctgatgagggcttgtatcccaagcacca

SEQ ID NO: 375118 - DNA, 427 bp, Homo sapiens
gagataataatgcctctcttgctataccgtagagattaaatgagattatgtttatttaaaaaaaaaaaaccctcgtctggtgtctggcacacagtaggtgctcggaaaagctggttcccttcccatctctacttatggtagggattcaggtatttgttgagtgaatgactgaatggtctcctgcatgtttcagttaagccttcagtggcctggcatccactttttgttctgtttgattcttactcttttctttgccttgtgtgtttcaggttcacaaccagtatccaactgagtttgaattcaatctctattacttaaagttcttggctttccactatgtgtctaatcgctttaaaacatttctcctggattcagactatgaaagattagagcacggtatgtgtctgtatgcccttgtttcatcttt

SEQ ID NO: 375119 - DNA, 4020 bp, Homo sapiens
gctagtattacaggcatgaggcactgtgcccattactaaacttataattctcattcttcatggatactgaaaaatataatataatcttgtttagaattacatcgttttggcatgatatacaaatattaattccaaatccagcttcagattttagtagacttatgaagtttctatttcatatctttaaatgtcatgttaaattgaccaaataagcagaagaatgttccttacttttttcatgaagccctgagaaattgcataactcagcatttgccttcctagactttattagtacctcctgccagcatgttttgttttcagtatcaatgtactgtttctgcttaagatcttagtatttacttttaaatcctgaatttacatcaaaatataaaataggattgatttgggggatttgctaggtcattctgaggctaagattgtgtgattttgaaatgctatattggataatgtttatgttacagaagtagcaaatgaccatatgacttacggtttttagattaatcagcttgctatgacctctaaaactgtagctccagagcatgcacctttttccttagttagtggcattcccacattagattatctcactccacgactttggcttttgtgaaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatattggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggacatcactgcacaagtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatttggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaa

SEQ ID NO: 375120 - DNA, 360 bp, Homo sapiens
tgaaaatatgattccccaccccccaacccaaaccaaatgagactcattctggtttctgtcttctaaaatgatatccttttcattaagatgaatctggtcccaatccaaagtgcaatgatgactgacagtagtgtctagtataattggagcagtgatggaggtggggcaggtaaatgcaagagtggcagaaattaatctgcagtcagaaattaatctgaccccagactaatgctggggcaggagagagagatatatgagagtgccagaatatggtagatatggtagatgccagggcagggtgaaggcatccaggtgggagctgaaatccagccaggatactgctagacaagctgtttttct

SEQ ID NO: 375121 - DNA, 187 bp, Homo sapiens
gcgggtatgggaatctcgagctctgagaaggagggtgatgacaggcatggcagtacttagttaagtgtccacatgtcccgcgatccagcaattccactcccgggcgtgtatcccacagacatcctcacccaagtccagaagggaccatgtccaaggatattcactacagcctcatttacagtggctg

SEQ ID NO: 375122 - DNA, 631 bp, Homo sapiens
gaaccactaattttacaaagagagttgtcctaaactgtgacaaattttccagtacttaattctttttacaattcattcgttttttaaatgacaaaattgtatatatgttgtgtaaaacctttttagaaataggtagatggtggaatgattgcattgcgctcaggaacatatgcatacttactttttgtggtgagaacccttcttgattttcaagaatacgatacattaactgcagttaccatgttgtgcaatgtatctcttaaacttattcctcctgtctaactacacttttgaatgatttcaccgtctccccaaacccctgcctcccacccccggtaacctccattctactctctgcttctgtgagtagaagcaggaggctggagaattgcttgaactcaggaggcagaggttgcagtgagctgagatcgagccgctgcactccagcctgtgtgacagagcaagactctcaaaaaaacaaacaaacaaacaaaaaaaacagagaatccagaggtcagacattccttttagtaaggactccaatatggtttctcacctactcactccaacaaaattgctcttctcaaagcacaaacgatattgttaaattatgaattaaagcataattcct

SEQ ID NO: 375123 - DNA, 411 bp, Homo sapiens
ttgatattgtgatccctttgacacttgtagtcggatcagatggaaaagaattttaatattgtgattgcatccaggagatggggcaaaggtgcctgttatgacttcatgaagactgtcaggccttaggtcagcacagacaagtgactttgggcctagtgcaatgcctcacgcctgtaatccgagcacttcgggaggctgaggctgaggtgggaagatcacttgaggccaagagtttgagaccagcctgggcaacatggtaaaccccgtctctacaagaaataaaattagctggctgtggtggtgtgcacccgtagtcctagctacttaggagactgaggcaagaggatcacttgagcccaggagttagaggctgcagtgagctaggatcacactactgcacttcagcctggg

SEQ ID NO: 375124 - DNA, 351 bp, Homo sapiens
gcaaaacagttaactctttgctaatctgcgagtaaataaaatgattttgctaataaattgagttttacataaagcatgaaaatttaaaaggacaacttaaaaaggtaaagaatggttgattacaaagagaacaatcaaaagttctacaagatgaacgtcatgggctaacaagaacctcaaattatgactcattgctacgtaatttaaatttcatctgtaatacagtaagcactagttgtgaaatgtttccaaaattgtatttaaatagtttgtatattcactgaattccttacatttcatgtttctaactgtaaatgaaactcccaagcctgagtcatgtttttaatttaa

SEQ ID NO: 375125 - DNA, 392 bp, Homo sapiens
atgttcccctgggatactcccagttcgctcaagtagcaacgttcaccacctttctctggtactaactggaatcggcctgcttatactactccttccaaagcagtaataatggtgctaattatatggcctgactaagtgcctgccattcgacaccttcctcttagtaccatgcatccttatgacagcactgcagtatacaggttattatctagggcaaaagttacagtcagagctgggcacagtggctcacacctagaatcccagcttacttagggggcccaagcaggaagatcacctgagcgcaggagttaggaggccaaggcagcaagaccgcgtgagcccagaagtttgagttccacctggcaacatagcaagaccaccatttctttaaa

SEQ ID NO: 375126 - DNA, 582 bp, Homo sapiens
ggaaagggccagatcccagctgtcactcactgtagtcatgaaccgaagccatagcatcactatagtaagataaaagaggtaccaagaggacaggaggaaacaaaatcagtcttgagtcacatatgggcatcatgggtatttataaaaggcttagacggttccttcctaaatttgaatttatgtcaagagataatcatttcaggaagtgtgagttcctctcttcaaactgttttggacaatcccattctgatatgagctgcatagagccaagctcatttatagggaacatctgtgtgggaggaagggggggagtggaagagcatagaaaagagacctcctgaagctgaacttggacacctcttgtgtcttttcctggtttcctttgagttgtacatttgcttggttgtgtgacaaggaaggtctatgaaacttttatggtccattatgtgggtttatgtatataacatgaaaaagtgacacgtggaagaggagtttcactgaaatctgcactctttttgtgaatgtctgtgttccagaaggttcctagagttgttggatgatggctctgattactgactcctt

SEQ ID NO: 375127 - DNA, 153 bp, Homo sapiens
tcatttattgtgcagaggtatgctttaaattttaagatactcaagttccttttctttttgtggtttatgttttaaaatcttatgtaataagtacttccccactccaatgtcataaagatattattttctttcttccgaacttttacaatattg

SEQ ID NO: 375128 - DNA, 381 bp, Homo sapiens
  misc_feature (29)..(29): n is a, c, g, or t
cataaccttagatggtgctcttgactttnctgtcatctgcagtgacttcgtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagattta

SEQ ID NO: 375129 - DNA, 325 bp, Homo sapiens
tctttggaatgaatattgttttattcccaacattcagagagacaataaataaatccatggtttaatccagtgattgaccaagaattgttttttgtgtctaggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagattta

SEQ ID NO: 375130 - DNA, 349 bp, Homo sapiens
gggaattcacatgttttattttgccacggcccatgatttcatcaatatcccattaaattttagtgtgacaactacatttagtttgttttcttacacagattcgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagattta

SEQ ID NO: 375131 - DNA, 738 bp, Homo sapiens
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagattta

SEQ ID NO: 375132 - DNA, 897 bp, Homo sapiens
  misc_feature (764)..(764): n is a, c, g, or t
  misc_feature (766)..(766): n is a, c, g, or t
  misc_feature (768)..(768): n is a, c, g, or t
  misc_feature (783)..(783): n is a, c, g, or t
  misc_feature (785)..(785): n is a, c, g, or t
  misc_feature (788)..(788): n is a, c, g, or t
  misc_feature (794)..(794): n is a, c, g, or t
  misc_feature (798)..(798): n is a, c, g, or t
  misc_feature (800)..(800): n is a, c, g, or t
  misc_feature (804)..(804): n is a, c, g, or t
  misc_feature (807)..(807): n is a, c, g, or t
  misc_feature (811)..(811): n is a, c, g, or t
  misc_feature (823)..(823): n is a, c, g, or t
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttacgcaaacaaaaaaaaacaaaaaaaanantntgtgggggcgcccgngncanaaaaantttntnaaancancgtntgggggcggggnccaagaaagatccagaagggacaaggcggtacaaagacaaatcgggctacacgggcgggggattccacatagag

SEQ ID NO: 375133 - DNA, 785 bp, Homo sapiens
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttaacaacacacacaacgacagagaaacacaaacacaagcataaaaagag

SEQ ID NO: 375134 - DNA, 1294 bp, Homo sapiens
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatattaaatccttctttaccatagctacagttaagtaggtgtatctcagaaacctaaggtagttttaaatgtagtgaaattgtccacagcaagctggcccaagtgctcacattttatacccgctctgtcttagtgcgttgcaagagaggagtatatacagtagttcccccttatccacaggggtacattctaagacccccggtgggtgactgaaaccacagatagtaccgaatcttatacatactatgttttttttctaaacataaatacctacaataaagtttaatttttaaattaggcaccataattaataataaaacagaacagttataacaatatactataataaaattatgtgtatgtga

SEQ ID NO: 375135 - DNA, 985 bp, Homo sapiens
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttactaccacacaacaacacaaacacacaacacaaactttgtgggcccctcgggacccaggaaaagggctcttagaaccctgctttgtgggccggcgccccatagaggtaacgcaacatggcaaacccgttccaagaaaccggggacaggaaaagggcgggtatccccccaaataagaagccggggaaccgcggtctgacaacccaagtggctcgggaccaaggggccacacgggcccagagccaaaaac

SEQ ID NO: 375136 - DNA, 780 bp, Homo sapiens
ccaggagctgacacggcacaacgatacaaatccctgtggaaacagatgctgccgtgccggcgggctgtgagcacagcatgctgcatgtgcccatctggacacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttaaaaaaacacacacagagcaccacacgaaaacaccgacaaaaa

SEQ ID NO: 375137 - DNA, 765 bp, Homo sapiens
cctcacaatcaaggacaaattcctgaatgcaacatttgcttttccgtcttcccgcttcacctcactcatccctgcagaagtacaagtattcctggcttcttcaagtctacgcctaagaattaagagccttggggagaagggcactgcatcgaccactgcatctcaatcattgtggcagacgtaccacagcactgggaagctggccttggcaagaatctcaggctattactacagagttgggaagaaggtttaggatcaagatagaggtgactgaccaagcatttctccttgttgccgccatgtgaagaaggacgtgtttgcttccccttctgccatgatcagaagtttcctgagtcctctccagccatgctgaactaaaacatgtcccaatccctggtgttgaggattctctggggagaagactcaccgtgaagaccttctcaggctgaccccgggctctcatgttggtgtcatgaattaacttcagaatcatccaagcttcatcatgttttccaacctaagaaatgagagtggacagtgaagcgctaggagtgacacacttaccctccctgattttccaatagccgtcttgcattgtcagatcaaatgaggtgtaattgtgcaaatgtatctcagtacatcccattggaacatacagactatttggatatcactgaatacatgagcagttcaaataatatggttataactagaaatagtatctccagatggtaagatttcgtctataaaacaataaaccatgtt

SEQ ID NO: 375138 - DNA, 672 bp, Homo sapiens
ccagagtgaaaaactttattaacaacaggtttcaacgagaaagcaaatgaatacccctagaaacatggacagcatctcccccagcagcaggcaggggaagggaggcaggaggggtaagcctagggtgttccctaggaaagggccaggttccctctatccagctgggggcaccgagacggcctcattcagggaagtccaggatggcagctgaaggcagcaggtttagcagccaaagcccaggcctagtggatagacagggtccaaaatgtgacccttctaggctggtatcaccatgggggcgtcatgggctgaggattctgcagataggacatcaccacggcagagatggacagcggcaagtctcacatgaagctactcatcatttgcttcgtgtcctccgagctccgagagttggcaaagctgatgaaggagcagtagacagcgacccaagcacaccacttcagctagggaaagcttaagcatgaggccgcacatgctgaagatcatgcccagcaggttcatgtagtccggcgtcgggtcgtccaaggccgggttacattcgctcggcgggggcttgtacctcagcactttgttcggcctccgtgggtccgacatattgttagtggacatagcgagtcgaaggccagatcacgcctcttccgctgcaggaat

SEQ ID NO: 375139 - DNA, 1475 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375140 - DNA, 2573 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcagggtgagtggagccaggacctggtctcaccccaggtgctacggggaatcatagctgcccccatgctcagattaaaacctactctcagctgggcacagtggcacacagctgtaatcccagctacttgggaggctgaagtggaaggatcacttgagtccaagagttcgaggcaccattgcactccatgctgggtgaaagacagactgtctacaaaataataataatctggcgtgagccaccgcgcctggtggaaaaaatatattttctattcattaagtggaagtgaagagatcgtcataaagatcttcgtgttgagaaagcagaggaggaggaagaggagggattgatcttggtgtctcacagctgatagaggcagaagaaaatccacatataagtggacgcgttcagttcaaaccgtgttgttcatgggtcaactgtactttgaaaagtgctccctctggtggctgtggggggtgcagggagaccagaacagtctagatgctggtgctgggtagtggggaaagtggtgggactgagtactgaggaggaggagctggagaatgcaggaaaagggggaattgggccaggtggggtggctcacacctgtaatcccagcaccttgggaggctgaggtgggcggatcacctgaggttgggagttcgagaccagcctgaccaacatggagaaaccccgtctctactaaaaatacaaaattagcagggcgtggtggtgcatgcctgtattcccatctactcgggaggctgaggaaggagaatctcttgaacccgggaggcagaggttccggtgagccaagatcatgccattgcactccagcctgagcaacaagagcaaaactctgtctcaaacaaaaggaagaaaagggggaatcagaaggactccaagggcttggaaagggggtgtgggtcttggaaatgatggagtaggacgtaattggccctgggcctgagtctcaaggccagagcttcagaattccactcctgtgcactggaagagcaggcccactgggctgggaaggcacagggctgcctggagccatgtgagtgtagtcaaggttcccgctggatctaccctctcctgcagctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375141 - DNA, 1562 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggcagggcgtggtggtgcatgcctgtattcccatctactcgggaggctgaggaaggagaatctcttgaacccgggaggcagaggttccgctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375142 - DNA, 2536 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcagggtgagtggagccaggacctggtctcaccccaggtgctacggggaatcatagctgcccccatgctcagattaaaacctactctcagctgggcacagtggcacacagctgtaatcccagctacttgggaggctgaagtggaaggatcacttgagtccaagagttcgaggcaccattgcactccatgctgggtgaaagacagactgtctacaaaataataataatctggcgtgagccaccgcgcctggtggaaaaaatatattttctattcattaagtggaagtgaagagatcgtcataaagatcttcgtgttgagaaagcagaggaggaggaagaggagggattgatcttggtgtctcacagctgatagaggcagaagaaaatccacatataagtggacgcgttcagttcaaaccgtgttgttcatgggtcaactgtactttgaaaagtgctccctctggtggctgtggggggtgcagggagaccagaacagtctagatgctggtgctgggtagtggggaaagtggtgggactgagtactgaggaggaggagctggagaatgcaggaaaagggggaattgggccaggtggggtggctcacacctgtaatcccagcaccttgggaggctgaggtgggcggatcacctgaggttgggagttcgagaccagcctgaccaacatggagaaaccccgtctctactaaaaatacaaaattagcagggcgtggtggtgcatgcctgtattcccatctactcgggaggctgaggaaggagaatctcttgaacccgggaggcagaggttccggtgagccaagatcatgccattgcactccagcctgagcaacaagagcaaaactctgtctcaaacaaaaggaagaaaagggggaatcagaaggactccaagggcttggaaagggggtgtgggtcttggaaatgatggagtaggacgtaattggccctgggcctgagtctcaaggccagagcttcagaattccactcctgtgcactggaagagcaggcccactgggctgggaaggcacagggctgcctggagccatgtgagtgtagtcaaggttcccgctggatctaccctctcctgcagctccgtggatggccgcgtgagacgctatgacgccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375143 - DNA, 1382 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatggtgagcgccttcgtcttcattccgggtcctcctcccgcctcctgagatcgacggcccagtaacccccgcctggtgttccccagtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375144 - DNA, 1908 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagataaaaaaaaaaaaaaaaaaaaaaaaaaaatttggggccggcctcgggccatcataagaaaaggcgttctaagaaacacacattggcttgaggacgccgcggagcccagtcaggtggaaagtaacacattggcgtaaatagagggtaaccaagagagatcccggggcatgcactctagcgcttgagatctgctacccaaattataaaaccgcccggggggaaacgagagcgtttggcaacaaaagcacagagaggaggaggcagacagaagcatacgaggggtcatttacaacacaagggagcagaacgagagcaccaggtattaaaatacgccaccacacgggtgaaaagcacagggagaaagaacaaagacagcgagaaaaaagacacaaaacacacacaaacaaccacagagagacaggcaagcctcagcgaacgaccaccgacgcaagcgcagcaccaccaccagaacaaccagggaacgagacaaagaaaagaagagaacaaaaaaaaacaaataaaaaaaagcagaaagcgagcaaaaagagagagaaaaaagcgaggaaacacacctacccccatgagcaagaacccggaagcaagaagagacagagaaacgagaaaagagcaggaagccgccgacagacaaccg

SEQ ID NO: 375145 - DNA, 1558 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatggtgagcgccttcgtcttcattccgggtcctcctcccgcctcctgagatcgacggcccagtaacccccgcctggtgttccccagtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcaggctccgtggatggccgcgtgagacgctatgacctaaggatggggcagctcttctcagactacgtgggcagccccatcacctgcacctgcttcagccgggatgggcagtgcaccctggtgtccagcctggactccacattgcggctcctggacaaagacacaggggagctgctgggcgagtacaagggccataagaaccaggaatacaagctggactgctgcctgagcgagcgtgacacacatgtggtcagctgttctgaggacgggaaggtgttcttctgggacctggtggagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggacgcagccgatcagtcctcgtt

SEQ ID NO: 375146 - DNA, 2969 bp, Homo sapiens
ggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccgggcaagtctcacatgaagctactcatcatttgcttcgtgtcctccgagctccgagagttggcaaagctgatgaaggagcagtagacagcgacccaagcacaccacttcagctagggaaagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatgtggatggcaattactgcctgacgtgcggcagtgacaagacgctgaagctgtggaacccgcttcgggggacgctgctgcggacgtacagcggccacggctacgaggtgctggatgcggccggctcctttgacaacagtagtctctgctccggcggcggggacaaggcggtggttctgtgggatgtggcatcagggcaggtcgtgcgcaaattccggggccacgcagggaaggtgaacacggtgcagtttaatgaagaggccacagttatcctgtccggctctattgattccagtatccgctgttgggattgccgctcacggaggcctgagccagtgcagacgctggatgaggccagagatggcgtgtccagtgtgaaggtgtcagaccacgagatcctggcagggtgagtggagccaggacctggtctcaccccaggtgctacggggaatcatagctgcccccatgctcagattaaaacctactctcagctgggcacagtggcacacagctgtaatcccagctacttgggaggctgaagtggaaggatcacttgagtccaagagttcgaggcaccattgcactccatgctgggtgaaagacagactgtctacaaaataataataatctggcgtgagccaccgcgcctggtggaaaaaatatattttctattcattaagtggaagtgaagagatcgtcataaagatcttcgtgttgagaaagcagaggaggaggaagaggagggattgatcttggtgtctcacagctgatagaggcagaagaaaatccacatataagtggacgcgttcagttcaaaccgtgttgttcatgggtcaactgtactttgaaaagtgctccctctggtggctgtggggggtgcagggagaccagaacagtctagatgctggtgctgggtagtggggaaagtggtgggactgagtactgaggaggaggagctggagaatgcaggaaaagggggaattgggccaggtggggtggctcacacctgtaatcccagcaccttgggaggctgaggtgggcggatcacctgaggttgggagttcgagaccagcctgaccaacatggagaaaccccgtctctactaaaaatacaaaattagcagggcgtggtggtgcatgcctgtattcccatctactcgggaggctgaggaaggagaatctcttgaacccgggaggcagaggttccggtgagccaagatcatgccattgcactccagcctgagcaacaagagcaaaactctgtctcaaacaaaaggaagaaaagggggaatcagaaggactccaagggcttggaaagggggtgtgggtcttggaaatgatggagtaggacgtaattggccctgggcctgagtctcaaggccagagcttcagaattccactcctgtgcactggaagagcaggcccactgggctgggaaggcacagggctgcctggagccatgtgagtgtagtcaaggttcccgctggatctaccctctcctgcagctccgtggatggccgcgtgagacgctatgacgccccatcacctgcacctgcttcagccgggatgggcagtgcaccctggtgtccagcctggactccacattgcggctcctggacaaagacacaggggagctgctgggcgagtacaagggccataagaaccaggaatacaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagataaaaaaaaaaaaaaaaaaaaaaaaaaaatttggggccggcctcgggccatcataagaaaaggcgttctaagaaacacacattggcttgaggacgccgcggagcccagtcaggtggaaagtaacacattggcgtaaatagagggtaaccaagagagatcccggggcatgcactctagcgcttgagatctgctacccaaattataaaaccgcccggggggaaacgagagcgtttggcaacaaaagcacagagaggaggaggcagacagaagcatacgaggggtcatttacaacacaagggagcagaacgagagcaccaggtattaaaatacgccaccacacgggtgaaaagcacagggagaaagaacaaagacagcgagaaaaaagacacaaaacacacacaaacaaccacagagagacaggcaagcctcagcgaacgaccaccgacgcaagcgcagcaccaccaccagaacaaccagggaacgagacaaagaaaagaagagaacaaaaaaaaacaaataaaaaaaagcagaaagcgagcaaaaagagagagaaaaaagcgaggaaacacacctacccccatgagcaagaacccggaagcaagaagagacagagaaacgagaaaagagcaggaagccgccgacagacaaccg

SEQ ID NO: 375147 - DNA, 338 bp, Homo sapiens
agggccacagggtattttccacgaggaatttagaaatagctgtcggcagagccttggtaggcaggctccctgtacccaggaccctcacacccacgtcccaattgccccaccaagggggcctgtgacttcccaagggactttccccccagggggactccacgccccccttctctctctgcatgcccagggtagagttgtggcccccaaaattcacatgttgaagtccaggacctcagaatgggaccttattgggaaataggatcactgctgactatacttagttacgatgaggccgtgttgtgtggtgggccctatcctcgacgacagttgccccacag

SEQ ID NO: 375148 - DNA, 351 bp, Homo sapiens
gcgccacaccgtaggagtccataacaagaagggctggcctctgttgcccgttgatgcatgagccatctcagcagagcaggccgtccccagttattccttgtcccagatgcctctgctggtttgtcctagtgcctgctaaccctcagctgttgccacttggatattatgtcaagcttttcttcccagaatttctgatttacgactgggtatgaagtcaaggcctacctgcatagacagacccctgtacttgggactcccacgaactgtggtcatggaaacaagcaccaaggactacctgacccttctaatgtcacttttctgcagagattaggaggagagactaagaaagcc

SEQ ID NO: 375149 - DNA, 213 bp, Homo sapiens
caagacccaatgaatgtagaactgggccacagtttgtcttggttcttaagcacgctggcccacacatgataggttatcattaaatgtctgatgagtaagtgaatgaatgtcaggaacctgagaggctttagaggtcatttacctcagctgaaattcaggcatccctttccctcagccctccttaaataccagcagtcctggggatcccaccac

SEQ ID NO: 375150 - DNA, 246 bp, Homo sapiens
aattacctggataattgcatttatgtaggccagactttaagtccctcttctctaacacaacacagcacaatacaacagacatttaaatttgtttctttgcttttaaaactttgttcttggcccggcatggtggcttatgcctgtaatcctagcacttttgggaggccaaggcaggtggattacttgagcccaggagtttaagaccaacctgagaaacatggcaaaaacctgtttctacaaaaagta

SEQ ID NO: 375151 - DNA, 348 bp, Homo sapiens
agacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaag

SEQ ID NO: 375152 - DNA, 423 bp, Homo sapiens
aagctctgctgactgtctttcagagtcacccttgagtggggttgtagggcagtagctacatattttcagctggtacacaaatactgagccgatctatcaatgagctaaatttgagatttttccttctatgccagctgatcataaggaatacttccccttccatgtgcccattggtgtcagttaaggaagaagcaccagtgcatcagttgtggatgacataggtgtctggaccacctgtttctgtagcttacttgggtcttttggcctgctagcacccaatcctgctggatgtaccactttatcttacaataaattgctgctggggcctgcccaaccttatgatggggtgggtctgacagacccaagctcatgataagcaatactgggaacacggttacttgatatccaaagggcaagtactca

SEQ ID NO: 375153 - DNA, 420 bp, Homo sapiens
tgaaactgaacattgttttttggggttctcgatgcctgggctcaagacaaaccaaaacctttgcaaaatgagggccctaatagaactctccgtaaagctggggccccaaagggtgacaccctctgtgaactaatagcaaatctgccctcctggcatcccatacaaaagttaaaccttgccacttactggactgaaaaaaaggtcttccttgagaactgagccaaccttcatgtgggtttttgtacatgagaatccaagaatttaagtggtcccactggtcccagaatgttggaagtctcaaacacttgatagaagaaaatgtagatcctacctggacaaagctttattcatatcagctctcaaagaattctccctgataaagtttcaagacatatgagaatcttagggcctactcagtga

SEQ ID NO: 375154 - DNA, 353 bp, Homo sapiens
attctaggaaaagaccttggtttcatattggctcctaaagtagacaagttcccatgccccaaggggcattggcatcctttatttgtcaaaggaaggaaataactacatatctactatacagtgatgttgggaaaaaggtctgtgaataatttatatagactgtaatgaaaagtaagtgacagttattattctcctagttatacaaattgtttgtcagttacttcatttaagtgaaattaaattatttgagttaatagggttgaatttgaaaattacattttgtttctgaagcttttatttttttaaatttattttattttttgagacggagtttcgctcttgttgcccaggct

SEQ ID NO: 375155 - DNA, 487 bp, Homo sapiens
ttcttttttttgagacagagtctcagtctgtagcacaggctggagtgcagtggtgcgatcttggctcgtcgcaagctccacctcctgggttcaagcaatactcctgcctcagcctcctgagtagctgggactacaagtgcctgctaccacacctggctaatttttgtctttttagtagagacaggttttctccatgttggccaggctggtctcaaactcctggactcaggtgatctgcccaccttggcctcccaaagtgctgggattacaggccctcaagtgacattttcaactgcagaatcccttggctctcttccttaagtcacgaaatccatgctgtgattgacattctctcagttttcagcttcacactgagaaagtacccagaccggtcaactacattaaaatctcaggcattgtgtttgctcatttcagcattaatattttcacatcattattctactgaatgtattacttactataagtc

SEQ ID NO: 375156 - DNA, 1693 bp, Homo sapiens
tatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccacccgcagctccccgggtgggtgagggatgccctggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgcctacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcca

SEQ ID NO: 375157 - DNA, 1265 bp, Homo sapiens
gggggtgtgcgctgttccgcataaccactgcctcccatgtcctcctcgagggccgaaccgagagggtgctggcagggctggatcccacgggtgtccgcaggagacaaaggcgaattccggagaaaaggctggggctgagaaaggcgctccgggagcggctggcagggcaattcggcaggctgcaccgaagccgagtgcccggagggacttgccgcccggaagggggtgtgtgggggcgctgccgtgaagatggatgagggaaaaggtttttgatatcagcagaagggaaaacgcctggagtggccgaacacttttagttgcccagcaggaataggagacgggtactcagctccccaaggctgcgcaatatcccagctttgcccgctcctgccctcgtgttcggaatatgctggcggtgtgaatgtgaaggtttctccaggcaggcggctggggcgaggggtgggcgcagctctgaggatcagaccaaatctaggggaaaaaggggaggcagaccttcgggtccttggttttgactttgctctgagcctatgattgactcttccgctttgcaggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcca

SEQ ID NO: 375158 - DNA, 1174 bp, Homo sapiens
tatccccatccttagcagggaggtgctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccacccgcagctccccgggtgggtgagggatgccctggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgcctacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggattgaaggagcaatgtttggaggaagcgaaagaaaggagaggacacagagcacagagcagccaggcagagccaggagctgagaagggcccagacctgaggcctcccaacaactctcttcttggaaggatctgggatgttgctgaaggaaaataaaaaaatatgtaaaaagata

SEQ ID NO: 375159 - DNA, 897 bp, Homo sapiens
gtctaggaaaaccgaaaacagttctagacagacctgcggttttatagcagttttggcagtcaacttcagcttgtgcctgagcagacggggttgtggtggcccgccagcgggggatgccaggccacctcccccagcggcacgcagcccctctcttaattagatcggttttcccctggtgtccgggagagcggtcccggcagaaaggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcca

SEQ ID NO: 375160 - DNA, 918 bp, Homo sapiens
gggggtgtgcgctgttccgcataaccactgcctcccatgtcctcctcgagggccgaaccgagagggtgctggcagggctggatcccacgggtgtccgcaggagacaaaggcgaattccggagaaaaggctggggctgagaaaggcgctccgggagcggctggcagggcaattcggcaggctgcaccgaagccgagtgcccggagggacttgccgcccggaagggggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcca

SEQ ID NO: 375161 - DNA, 1127 bp, Homo sapiens
ccagagcagagaaactggtagagactcctataagactgaaatcaaggtgtcagccggccttgatttcagtcttatgggacccagagcagagaaactggtagagactcctatacttctgatgtacagaactgtggggtcataactgtgtgtggttctaagctgctaagtttatggtagtttgttacagcagcaatgtggggtagggaacattacactgttctttgagtgtggaaagctcttccttacagctgctgcttcaagttagtaaaatataatttctccagcaagacctcctttgaccactggggagatagcctccactaacttccaacacgtgcatgccatcactatcatattatcctacattttttattggtaactgttactaactgaaaatacttatgcttactgtctttgtctctaatcctatttcacacccattagaaagttctttacagctagggactttatgtgcacttcacaaccatgcaagattcatgagacttctgaaaaacccaacatcatgagaggcacccagagaagaagcagagtgattcccatcaaagaaaaccattgattcaggagactgagtagagctttagaaagtctcgatcccagaagacatggtagccaccaaattttagtgactttaaacaacacacattaatgaccttgtagtttctttcaggcttagctgggtcctctgcttcagggacccacagggctgcaatgaaggtgttggtcaggactgtggtctcatctgaggcttgttggggaaggatccacttctcagctcacatggtggttgggcaacattcagtttcttacagatggctggacagagggcctcagttcttgccatctgttggctggaggttgccctcagttccttgccatgtaggcattccagtgtggctgcttgcttcctcaaagccggcaggggagagacgcctttccaagtagcacagatgttactatcttctgtaatgtaatcacacaggcaacactttgtcatctttgctgtattctgtagggtgagagcaagacacaggtccttcccactcttagggaagggtattaaaaatgacaactaccaggaggtagggatcatggagcctgcttcagaa

SEQ ID NO: 375162 - DNA, 1302 bp, Homo sapiens
tgagacgttgatgatgctcctatcaccatggttatgtgattgggtatatcttgccctcggtcctaactgccactgtctgtgctgagtttttcaaagttcatagcaggttgaacatgcttgctgtcattttcacagattctggtctttcttatggggaacctgagttcctgcattaaagttcccccagaagatcaatggaaggtggattccaaagagtgggcaagtgaggaccccttctctgttaccaaggtgaccccaaggaacacagtaaatgaaattttaagaagatatagcctctacaccaagaggcacatgacacaacctggactctgggcaaaccaccgggtgcactcacatgaagtggcggcttatttggcctccccaggacggactggagcatcagtagtgcctgagttcatcaaaggacagatgctcaagacaccttgatcaccattaggtggaattgaaggagccaaaaatgggcgcagtggctcctcagcagagacgctcctgaatgtatagacatgggaaccactttcagcatcaaaaaaggaaacgttctgcatgcccatatccagaaaaatccccactcgctgtaacttgcggtctactaagaggaaagtcagcggcaccgtgctggcagagaggcggcttccatccctcaaactcacagtccagaatccaagctctgtggtcagctggatcttccctttgcagtgaacagattctctgcagactcccaggtcccattctgtgcttgttcccacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactgaacttttcttcatttagagtggagggtctctgaaggcagacaccatgcccccctttctaccaccttgatgtgtgaacaaataaatgataattaagacaaaaaaagt

SEQ ID NO: 375163 - DNA, 1215 bp, Homo sapiens
tgagacgttgatgatgctcctatcaccatggttatgtgattgggtatatcttgccctcggtcctaactgccactgtctgtgctgagtttttcaaagttcatagcaggttgaacatgcttgctgtcattttcacagattctggtctttcttatggggaacctgagttcctgcattaaagttcccccagaagatcaatggaaggtggattccaaagagtgggcaagtgaggaccccttctctgttaccaaggtgaccccaaggaacacagtaaatgtggcggcttatttggcctccccaggacggactggagcatcagtagtgcctgagttcatcaaaggacagatgctcaagacaccttgatcaccattaggtggaattgaaggagccaaaaatgggcgcagtggctcctcagcagagacgctcctgaatgtatagacatgggaaccactttcagcatcaaaaaaggaaacgttctgcatgcccatatccagaaaaatccccactcgctgtaacttgcggtctactaagaggaaagtcagcggcaccgtgctggcagagaggcggcttccatccctcaaactcacagtccagaatccaagctctgtggtcagctggatcttccctttgcagtgaacagattctctgcagactcccaggtcccattctgtgcttgttcccacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactgaacttttcttcatttagagtggagggtctctgaaggcagacaccatgcccccctttctaccaccttgatgtgtgaacaaataaatgataattaagacaaaaaaagt

SEQ ID NO: 375164 - DNA, 1188 bp, Homo sapiens
gtacaaccacagggctccccatgaggtgatgtcatcgaattttcctggctgaagagtcgtcctttgtgtacacacatgggagtttattttttcatctgcatatggacgattctggtctttcttatggggaacctgagttcctgcattaaagttcccccagaagatcaatggaaggtggattccaaagagtgggcaagtgaggaccccttctctgttaccaaggtgaccccaaggaacacagtaaatgtggcggcttatttggcctccccaggacggactggagcatcagtagtgcctgagttcatcaaaggacagatgctcaagacaccttgatcaccattaggtggaattgaaggagccaaaaatgggcgcagtggctcctcagcagagacgctcctgaatgtatagacatgggaaccactttcagcatcaaaaaaggaaacgttctgcatgcccatatccagaaaaatccccactcgctgtaacttgcggtctactaagaggaaagtcagcggcaccgtgctggcagagaggcggcttccatccctcaaactcacagtccagaatccaagctctgtggtcagctggatcttccctttgcagtgaacagattctctgcagactcccaggtcccattctgtgcttgttcccacgtccacctcccagtagtggcggccacaggtaaagcgaggggagcccaggatgcaaacggacacgtcaaatctctcggcaaggtcttgccgattctgtgtgatgagcccacttcggacgctcctgaggtcgtcagaaatgaggaggaagttgttggctgtgtcggcatccaaggtcatatccactgtgaaaaggaaaacaagttgctcagcaagtggacagaagccaaccccatgcctctcttctacttcaaaggcccaaatatctcctgactttagtttctttaattctgtttcttcctccaaaatcaaaacttttcatgaggaaacttccctatttcaaattttcataggtatgctttgtggcaatacgtgactcttattcacagtagcaattcttattttactttacgtcacgtgtttgcttcactgaacttttcttcatttagagtggagggtctctgaaggcagacaccatgcccccctttctaccaccttgatgtgtgaacaaataaatgataattaagacaaaaaaagt

SEQ ID NO: 375165 - DNA, 2780 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctg

SEQ ID NO: 375166 - DNA, 464 bp, Homo sapiens
ggctcctgtacaaggtgctgggcgtcctcttctttgccatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctg

SEQ ID NO: 375167 - DNA, 547 bp, Homo sapiens
gaactagggaaaggggctgtgcatcaggcggacggtgctggggggcatgggtgtgccttccttgcgtgaggaggaaaaaccattctatcaccagaaggcagtgcccagtggtgccctgcagccacggagacgaatgtggacggccagaagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggctcccctgctgaggattcatcccaccttggatggaaaatgcagtttttgtgggagatggaactggagggtacggagggctgactgcacatacaaatatacatacatgagtgtacatatgttcttatataaacgtgtcacagtaaaattgttcctc

SEQ ID NO: 375168 - DNA, 3412 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggcaaggtcagaacttattctgcagggagctttggggatattggatactaaggcccaagccctctgtgatacgcctttcgctttggcataaaataacggttgactctctgttaggcgcgtctctgctcagggagtggtggtgtttggggaagcccaaaggcacatgagcatcaggaaattgaccatttgacttcataagacataacctttgtccagcgtgtccaggctattcatgccaccacctgttgatcacttagcagccggtgtggttcccacatcccccatcaccatatcacagtgccatgttcaagccactcttatttacctaatcatggccccaaagcaccggagcactcacgccgccgttcagctctgccaatgggaagccggaggcgcctccttcagcgagaaggtgtagttccttggctgggcttagtactacccttagactcacgcgtccacaggggtctcagtgtctgcggatgagggggctgctgtactttcccagggagccgtccccagactctctctttgctgtgttggatgcatcccttagctgggagcagcaggctgagagccctccacacgcagccatcccctgggctcagcacagccagcgggagccgtatccagagggtcagagttggcctcagcagcgcatgcgtccatgttaattgtagcgggggagcacacggtgtctccttataaacaccctcgcattccactttgtcctgcaccgagtcaaaacagcctcactccctgaatgcaggctcagggccatcagccaggctgacactccaggaggcacagtgggtgtttctggtccacacccagcgtggaaatcatagtggtgcacatgtactctgcgtgggcattgcggcagcatccgtgcttggacctcaccgcctttggggcccacgtgggattcctgccacatcgtcctcttgccctgcaaagtcggtgcagcccctcattgttgacaaagaaaccaagaccctgaaggttcagaact

SEQ ID NO: 375169 - DNA, 3805 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggcaaggtcagaacttattctgcagggagctttggggatattggatactaaggcccaagccctctgtgatacgcctttcgctttggcataaaataacggttgactctctgttaggcgcgtctctgctcagggagtggtggtgtttggggaagcccaaaggcacatgagcatcaggaaattgaccatttgacttcataagacataacctttgtccagcgtgtccaggctattcatgccaccacctgttgatcacttagcagccggtgtggttcccacatcccccatcaccatatcacagtgccatgttcaagccactcttatttacctaatcatggccccaaagcaccggagcactcacgccgccgttcagctctgccaatgggaagccggaggcgcctccttcagcgagaaggtgtagttccttggctgggcttagtactacccttagactcacgcgtccacaggggtctcagtgtctgcggatgagggggctgctgtactttcccagggagccgtccccagactctctctttgctgtgttggatgcatcccttagctgggagcagcaggctgagagccctccacacgcagccatcccctgggctcagcacagccagcgggagccgtatccagagggtcagagttggcctcagcagcgcatgcgtccatgttaattgtagcgggggagcacacggtgtctccttataaacaccctcgcattccactttgtcctgcaccgagtcaaaacagcctcactccctgaatgcaggctcagggccatcagccaggctgacactccaggaggcacagtgggtgtttctggtccacacccagcgtggaaatcatagtggtgcacatgtactctgcgtgggcattgcggcagcatccgtgcttggacctcaccgcctttggggcccacgtgggattcctgccacatcgtcctcttgccctgcaaagtcggtgcagcccctcattgttgacaaagaaaccaagaccctgaaggttcagaact

SEQ ID NO: 375170 - DNA, 2583 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggaagaagagaatgaatttagaaggctgtaaaccccatctgagccttacacatagatctccttgaattggattttcaccaaggccgtgatggatgtggagtctcggctttctgacaacgtcttccagagcaggctttctctagagggtggactgcctgtgttctcctgggagagaatgcatttgcttccgatgcccagggcacgaaagaggtggacgaaacaacggaagtggagggggtggattctctacctgggaaacccagcatggcacactcatatagaattaagatcttataataagtgtgcagatgcgcccgttctaaggaaataaagggttctgccctccta

SEQ ID NO: 375171 - DNA, 1694 bp, Homo sapiens
  misc_feature (1118)..(1118): n is a, c, g, or t
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacaccccccacaaaaagaagacctacaaaacattcaaaaaaaaaaaaaaaaaacaaaaacaccaaaaaaaacaagaaaaagaaacccgagagcgagcactaaagcgcgcgggtcgcgggacaaaagcggcgtcataagacacggcgccaccgatggcgccaaaacgcgggtaccacgggacccncgggttttctgggagcacaggggggaaaatcccgcgcggggagcgactccccccaataaaggagagcggaggcgaccgaaataaactctcgcgcaaaaaggcgccgcgaggggtttaaaccggcgccacatataaagaaaccccggccgaacaagactggacgagcacacaaacacaccgcgacaccacacagagagacaccgacccaaaaccacacacagaacgcgaccgacgaacacagacacagataacaacaacacaacgcgcgggcgcacggcaaggcgaccagcaagagacaaaaacagagcaaggcaacgcgaccgagcccggcccaggaagcaaagccaacagagacaaacacaaagtcgatggaacaaggaaagacaaaacccgccgaaaaacaggacgaaaggagacgggagagaaagaggaggcagacagcacaggaagggaaagaggaacgggaaagaggatcgaagcgcggacacaggcggaagaggacgggagaggacacaagcggggtgggacggcagcaggcagggaacggagacacagacgaggcgaggcgaaagaagc

SEQ ID NO: 375172 - DNA, 831 bp, Homo sapiens
aaaggtcccattcactggtgtctggcactgttcaacccatgacaagcccctcagtcctgtgcctctgtttttagtcaaagggtgtgtttcattccctctaacaatattggcgtctgctctacaaaccggttatatgggaaagataccctctcagagcaggatgggtttccgtggacctggtgagggtgctgcaggctggggcagggacaggactgggacaggcccaccagtatccaaaggctctggccgagctccccacgaggtccagcgggctcctctctccccaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctg

SEQ ID NO: 375173 - DNA, 337 bp, Homo sapiens
tctcttctccacacccccacctctgcccagctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttggtgagaaaactgaatcttgggggtcctctgcttttatgtcagttctcagaaacagagtcttcaagggcatcttctagaaagacccagacagggcacatggcagtgagtgccctcccacccccgctgccagagcaggtgtggagagcgccacg

SEQ ID NO: 375174 - DNA, 3173 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctg

SEQ ID NO: 375175 - DNA, 3098 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctgcgtccccgtaccgcgtgctttatttctatgagtttgcagagtttggtggtctcgccatccttggcccacgtcctgtagtcagccctgtggaatccgtggatatgaaaagttggccttccttatccacaggctcccccgtaagtcggccttccttatccacaggctcccctgctgaggattcatcccaccttggatggaaaatgcagtttttgtgggagatggaactggagggtacggagggctgactgcacatacaaatatacatacatgagtgtacatatgttcttatataaacgtgtcacagtaaaattgttcctc

SEQ ID NO: 375176 - DNA, 2607 bp, Homo sapiens
ctccctctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaagcctg

SEQ ID NO: 375177 - DNA, 1882 bp, Homo sapiens
tgcccagcgtgctgggggcggtgcaagcttggcaagtttgtagacccgaaatgcaggctgcatggggacgagccccatggctgaccctgtgcctgctgggcgccagcatggctctggcctggaccctaccactcgcttgtcccccctctgcagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagtttcagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaactttggaagaaggcaaggtcagaacttattctgcagggagctttggggatattggatactaaggcccaagccctctgtgatacgcctttcgctttggcataaaataacggttgactctctgttaggcgcgtctctgctcagggagtggtggtgtttggggaagcccaaaggcacatgagcatcaggaaattgaccatttgacttcataagacataacctttgtccagcgtgtccaggctattcatgccaccacctgttgatcacttagcagccggtgtggttcccacatcccccatcaccatatcacagtgccatgttcaagccactcttatttacctaatcatggccccaaagcaccggagcactcacgccgccgttcagctctgccaatgggaagccggaggcgcctccttcagcgagaaggtgtagttccttggctgggcttagtactacccttagactcacgcgtccacaggggtctcagtgtctgcggatgagggggctgctgtactttcccagggagccgtccccagactctctctttgctgtgttggatgcatcccttagctgggagcagcaggctgagagccctccacacgcagccatcccctgggctcagcacagccagcgggagccgtatccagagggtcagagttggcctcagcagcgcatgcgtccatgttaattgtagcgggggagcacacggtgtctccttataaacaccctcgcattccactttgtcctgcaccgagtcaaaacagcctcactccctgaatgcaggctcagggccatcagccaggctgacactccaggaggcacagtgggtgtttctggtccacacccagcgtggaaatcatagtggtgcacatgtactctgcgtgggcattgcggcagcatccgtgcttggacctcaccgcctttggggcccacgtgggattcctgccacatcgtcctcttgccctgcaaagtcggtgcagcccctcattgttgacaaagaaaccaagaccctgaaggttcagaact

SEQ ID NO: 375178 - DNA, 4173 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375179 - DNA, 4422 bp, Homo sapiens
acgtgagtgtgttagagggaggcgaggaaggggctgggagagatttcccagtgaaggggggcatttgaggtagactttgaaggaagggtaggagtttgccagaagccatggggcctggggagtaggaacagcatggagggatgaaaagaaggcgatctgagaaaatgggttttgaggagctctgaatattagtgttagaattccctcaggtaccccagggccccagccagagatcagcatatacagtacaggaggctggccaggtaccccgacaggctaaggggttgccagcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375180 - DNA, 4042 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactaggagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375181 - DNA, 3446 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgatgggagaagatgcgtcttgctcccatcaggacatgaaaaaaatattaatgtttcacttttactcaaagggcatcatttgcgatatatgcacgaagcaaaaaagcagaaaaaagagtacctctgatgggacagcagac

SEQ ID NO: 375182 - DNA, 4087 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375183 - DNA, 4321 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggacacgggatattatagaggagagtggcagcatgctgagtggtattccgatctgaatcacactgtcatcctttatccggctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375184 - DNA, 3768 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375185 - DNA, 2891 bp, Homo sapiens
gaccggaagtccctccgcctccactcgccctcgtgctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgtgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg

SEQ ID NO: 375186 - DNA, 3148 bp, Homo sapiens
ctccatctcaaaacaaacaaacaaacaaacaaacaaacaccctgcaatatcaatccaagagatcctggaatgcctcttgccctgtgaaacctggcagagccctgaggtttgggtcagtgccccctgccgtgggtctctggcctacaaaggcaccatggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaagacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggagg
